United States Patent 12,642,819 (COMPOSITIONS AND METHODS FOR TREATING INFLAMMATORY BOWEL DISEASE) - sequence listing, part 40

SEQ ID NO: 14 - DNA, 5190750 bp, Bacteroides vulgatus (residues 1-1,730,250 of 5,190,750)
  modified_base (1058184)..(1058283): a, c, t, g, unknown or other
  modified_base (1378708)..(1378805): a, c, t, g, unknown or other
  modified_base (1406488)..(1406586): a, c, t, g, unknown or other
  modified_base (1410495)..(1410592): a, c, t, g, unknown or other
  modified_base (2030081)..(2030090): a, c, t, g, unknown or other
  modified_base (2936531)..(2936630): a, c, t, g, unknown or other
  modified_base (3368378)..(3368471): a, c, t, g, unknown or other
  modified_base (4365641)..(4365740): a, c, t, g, unknown or other
  modified_base (5145376)..(5145498): a, c, t, g, unknown or other
caatactttgtgtatgaattagttggctgattttgtaatatttaatgaatgtccctaaataaaggcggctctttaataaaagccgcctttattcttactttctcattttaccttcttaccttaaaaaaacaattataattcaataatcaatgattgacgtgcaccgactgtcatatttttggtaaggtcaatttttttgccactgataagttctttaccgctttttgaatcatttgtcattatgcggtagtggtcatttgccaccacttgttcggcatcggtgctgtttaggacaatgagttcagttttcccagaattagtacgtgcgtacatatatattccgtgttggggaatatggtacttaactgttttcttttccatcttcgtttaatttagtttggttttacggcggcaaatttatatgtttttcagcatatcttatataactaatcgttcaaaaatcataataaatcattcatttcttaatctatatcaataaaaaatcctcttccacatattagttgaagaggattttatttattgtttttcaatgaattacatcaagaacccaagtaaaataccggcagctacggcagaaccgattacaccggctacgttgggacccatggcatgcatcagcaagtagttggtaggatcatattccagaccgataacctgagagatacgtgccgagtcaggaacagcagatacaccggcattgccgataagcggattgattttgttatccttacctaataccaagttgaatatctttacgaagataactcccgaagcggtagcaatgatgaatgacaatgcacccagcgcgaaaatcaaaatcgaatcaatggtaaggaattctgaagcttgcgtggaagcacctactgtcaatcctaataagatggtaatggtatcaatcagcggaccgcgggcagtttctgccaagcgacgggttacaccgctttctttcaataagttaccaaagaaaagcatacccaatagaggcagacccgacggaaccagaaaacaagtaagcaacaaaccaatgatagggaacattactttttctgtatgagaaacgacgcgtggtggtttcatacggatcaaacgttcgtgcttggtagtgagcagacgcatgataggcggctggataaccggtaccaatgccatgtatgaataggcagataccgcaatagctcccatcaggttaggcgccagtttggatgaaaggaagattgctgtcggaccgtccgcaccaccgatgatgccgatagcaccagcctgcatcggatcaaagcccattgccaatgcaatcatgtatgcaccgaaaataccaaactgtgcggcagcaccaatcaacatcagtttaggatttgaaatcaatgccgagaaatccgtcattgcaccgatacctaaaaagataagtggtggataccatccggaggtaactccttgatataaaatattaagaacagaaccttcctcatagatgccgactttcagtccggcttccatgttgaaaggaatattaccgatcaagataccgaaaccgataggaatgagcaacatcggctcaaattccttggccacggcaaggtatatgaagaataaacctatcaggatcattacgatatgaccaacagtagcattggcaaaacccgtatatgtccaaaagtcagctaggttattccctaaaaagttgataaattctcccatattattcaataattacaaggtcagtaccttcgagaacggattctcctttacttacattgattgcggtgatcttgccgtctttgtctgcattgatgttattttccatcttcatagcttcaaggataatgatggtttgccccttttttacggtatcacccacatttaccttgatatcaaggattacccccggcaacggagatttaacgcccgatttacctgtagaagttgcagcaggctttactactgtagctggtgccggagcagggctggttgatacaggacgaactaccggtttcactacagctttcggagctttttccatttccactttgtaaggagtaccgttcacttcaacatgagcgatattgtcttctatatctccaatggcaactttgtatacgttaccgttgatcttatatttatattctttcatcattttatctttttattggtgacttactttttgtggggagtttcacgcaaggtataaatcttggaactccacggtgaataactacgttttacacgggtaatggtaagaacggtttcttccacgtcatgtacatcgctttgcatttcatgcatggccatggcgatagcggcgaatacttcgcccggagcttcacccaatttcttttctttggcttcttgcttgtcggtaataccttttaccttcatggcattgcgcttgctcaggtttacagaaatcttacctacacatttgaagagaatgaaaagtaaaagaagaccgcagaatacaacgctcatagcagagatggccataccgataccactaccgtcgtgttcttcgaatttttccatctttgcatgactgttgatagtcttgttattggtgctcggagtcacatatttgtctgcgctggaacctttcacctcccattcatttgctgcgtcgctgacacgtgcgtatgattggtttgcttgcaatgtgcctgccggaacaataatctgatccaataattttttgcctgaatcatacaatccaatccaattgtcggttgcggcattcagtgtgaaattagtgtggaaagtaccgcggttgggttcgccgtctgcccagaataaagcgtgctggcgaggtttgaccaaagtcaatacatcacctttagggataaaataagtagcagtatctccaggctggctgctcaccttcagtaaacaaccggcaaggtctgcgctaccaaatgatctgttgaatatttcaatccatgcgctgtgtactccgtagtcatcctggaaattgctttcattttcaatcagcacttcattcagtaccagcttggtgttcgatttctgttctccacaagaacataaccccaccatcagcagcaaagaaaggaatattcctatatttaatttcttcatgttcaattctcaatttttaatttttaattaaagaggaatattaccatgcttcttagccggattggttaatttcttagtctgcaactgttgcaatgcacggatgatgcggaaacgggtattacgcggttcaatcacatcatcaatgtagccatatttggcagcattgtaaggattggcgaacagcttggtgtattcagcttctttttcggctaggaatgcggcaggattttcctgttctttggcttcgcgtgcgtataatacttctactgcacctgcaccacccataacggcgatttcggcagtaggccatgcataattcatatcaccgcgaagttgtttacagctcattacaatgtgagatccgccgtatgatttacgcagggtaattgtcactttgggtacagtcgcttcgccgtaagcatacagcaacttggcaccgtggaggattacaccgttgtattcttgtcctgtacccggaaggaatcccggaacatctactaatgaaacaagaggtatattgaaagcgtcgcagaaacgtacaaaacgagcacctttgcgtgacgcattgctgtcaagcacacccgctaggtatttgggttggttggcaacaatacctacagactggccgttgaaacgtgcgaaaccaatgatgatatttttagcgtagtgaggttggacttccaaaaactcaccattatctacgatggcgctgatcacctcatacatatcgtatggtttgttggggctgtcggggataatttcgttcaaagagtcttccagacggtcgataggatcggtacagtctacatagggagcttcttccagattgttctgaggaatatagcttaacaatttgcggatcatggctaacccttcttcttccgtcttggcagtaaaatgagtaacaccggatttggttgaatgaacgcttgcaccacctaagttttcctggcttacatcttcacctgtaacagtctttaccactttcggtccggtaaggaacatatatgatgtgccttccatcatcaaggtgaagtctgtcagcgcaggagagtaaacagctccgcctgcacaaggaccgaaaatacctgagatctgcggaataacacctgaagcaagaatattgcgttggaaaatttcagcataaccggccaatgcattgataccttcttgaatacgtgcgccacctgagtcgttgataccgatacagggagcacccattttcatagcttgatccattactttgcatattttcagagacattgtttctgaaagagaaccggcagaaactgtgaaatcctgtgcaaagatgtaaactaaacgtccttctatggtaccacaacctgttactacaccgtcgcccggataatgttttttctccatgccgaaattggtgcatctgtgttccacaaacatatccatttcttcgaaactgccctcatccagcagcatggctatgcgttcgcgggctgtatattttcctttatcatgctgttttgcaattgctttatcacctccacccatgcgtgctgtagcccggcgttcgataagctcttttattttttcaagttgattgctcattttacttatgattttacaatttacgattaaaaaataattctatttacgcttgaaccagactaaatatactgacttcaatcgtgaatagtcagatctcgtgttttatggtttttcgcaaagctcggtcaggacgcccaaagttgatttgggatgtaaaaaagcaatttgcaaaccttcagcacctttacgcggagctttgtcaatgagacggatgccggtggtttcagcttcggctaacgcatttgccacaccatcttccactgcaaaagccaaatgatgcataccaccgttgccattatttttttcaatgaactttgcgatagtgctttcggggcttgtaggttccagcagttctattttaacatcacctactttcagaaaagcggttttaactttctgatcctctactgtttcgatattgtagcatttcagacctaatacgttttcataatacggcagggcctcttcaatgctctttacggcaatgcccaggtgttcaatgtgtgagattttcatgatcttataattttaatagtttggttttatactcaagttttcagataaaactgcacaaagaaagtaatttcgagttaaataaagaaatatttcttcaattttatttcttatttgcaagatgcttcacaacactttagacaaaaagacaaaaatgagttaaatatagaatttgcacaagagtttgttcagccacttccaactgaagcggaaccagcggcgtgtactgctctgcttgccgccaaagcggagtacaaagtccctgtaaccgtgctttttgaacggtaatcctgcatccatgaattccaaatgtgcatatcctttttcgtaagcataggtaataggtgcccatacggccagaataccggggtaaagaaaagcataggttttccgcatgcctcctgagaaccacaggtaggcactttcttttgagaaaaggcagatagaaccaccgatgattttgcctttatatttcacaagaaacactttggctaattctttttccgggttctgccatgctaataaccggaaaaagccgatgtccgggaaatgttttcttatctgtgaggaataggcttttttcaacattcgtgagaaatcttgtatatctttctcattgtcggctatttccatgatggcaccatttctcagagctttgtttatttgtcttctgcgagacatgctcagccgttcgtaaggagctttactgtgcagtgaattacgtactcttagccaattaatggcgaaatagttgttctttctgaaggctttgtatccgaatagcggattttccaagttgcggaactcgatgaggaacgatttgcataatacttcgttggtgagatgttccaatatttccccgaacaggtcttccttattctgttcttcatcaaaatactcgcctgtgccataaatttcgcatcgtttgatgattgcaggggggaacaggcgcacacttttccggatgactgccagcagtttgcctacaggacggtttcctatataggctacgataagcaaaggttcgtatccccgggtcatttcaaagacatgaaacagctcggtagaatggaaaatgtttgttcccggcagagggggaatggcatttcctttgcgatatgtacttaatctgacaggcatctctaattgcaaatttattgttttttgtttatcaatccacattctagttgtatatttgtgcagaaaaataaattaacagggtatattatggaacaatttagtgacttaataaagaacagacgcagcatgcgtaagttcacggatcaagagttgacacaggaagaggtagttgctttgttgaaggctgctttgatggctccgtcttctaaacgtagcaattgctggcagtttattgtggtagatgataaggatatgttggaaaaactttcccattgtaaggagatgggggcggctttcctagcggatgctgctatggctgtagttgtgatggctgatccgttggctagtgatgtctggattgaagatgcgtcaattgcttccataatgatccagttgcaggcagaagatttggggttgggaagttgttggatacaggtgcgtgaacgttttaccgctaccgggatgccctcgggtgaatacgtgcatacgttgcttgatattccgttgcagttgcaggtggtttccattatagcggtagggcataagggtatggaacgcaagccttttaatgaggagcatttacaatgggagaaaattcacattaataaatatggaggcaagtaaacgtggctgctgtcaatcataaggatacgtataaagcttctgcggtgtttctcattgtgatggggatgctttatctgatcgataagtttataggatttgcttcacacgggttgccatgggttatgcagaaagacaatctgttactgtatgcagctgttattttcctttggttcaaggtcgataagtcagtaggaattgtattggcgggtatatggctgatattgaatatcggtctggtgatagctttgttgggacagatgtctgcttatttgttgccggcggctttgttgctggtgggagttattttatatttagtttcgacccgatgatgaaaatagttctgataggagccggcaatgtggcaacccatctgggaattgctttacaaaaggcggggtgtcttatcttgcaggtatacagccgtacagaggaatctgcttctgcattggctgccagactttcagtagactacacaattgtgccggacgagatacgtcgggatgccgatttgtatattgtagcgttgaaagatgcagttttgcgacaattggctcctgtattggtgaaaggaagggagcaggccttgtttgtacatacggcgggtagtatgtctatggatttatggaagggattggtaaaacgctatggggtactttatcctatgcagacttttagcaagcagcgtgaagtggatttcaatactgtacctttttttatagaagcatctgctccggcagaagtggaattgctgcgtatggtggcagttcgtctcagtcctaaagtgtatgaagtgacttccgggcaacgtaggtatttgcatctggcggcagtctttgcttgtaattttgcaaaccatatgtatgcattaagttcacatatattggaaaagcaggggattccttttgaagtgatgcttccgctgatagacgaaactgccggcaaagtacatgaactttctcccacacaggcgcagacaggtccggctgtacgctacgatgaaaacgtaataagcaaacatttggagatgttggcggatgaggagtctttgcaggaattgtacgaaaagataagtaaaagtattcataatctccctttgtctgtcattcaggcaaataaagagggaaagaactcataagtggtatgataaactatgatttaaagaaaataaaggcattggtatttgatgtagatggggtattgagtgcggaaactatttatttgcaccccaatggtgaacccatgcgtacggttaatatcaaggatgggtatgcattgcagttggctgtgaaatgcgggctgcatgttgccatcattaccggtggaaataccgaggcggtgcgtaagcgttatgaggggctgggtatcaaagatgtctatctggctgctgcggtgaagacccgggagtatgcccatttgaaggaaaaatatggattgcaggatgaggagatactctatatgggcgatgatattcccgattatgaagtgatgcgtttgtgtgggctgccttgttgtcctgctgatgcggcacctgagataaaggaaacagctgtttatatttctcatcgtaacgggggatatggatgtggccgtgacgtggtggaacaggtcttgaaggctcaaggaaaatggatggctcatgaaaaggccttcgggtggtaatgaaataaagaaaagttatgttggaaaatttagaaaaatataaaataatccttgcttccaattctcctcgccgcaaagaattgttatccggcttaggtataaaatatgaagtaaaaacactacccggcatagaggaaacctatccggatacattgaaagcagaggaaatccctttgtatatagcttgcgagaaggcggctgcttaccggaataccatgcatccggacgaattgattattactgccgataccattgtatggttggatggtgtagtcatgggcaagcctcataacgaggatgatgcacggcaaatgttgtggaagctttccggcaagacccatcaggtgataaccggagtttgtctgactaccgccggggctcagcgaagtttttcagctgtgacagaagtaacgtttgcagaattgtccgatgaggagatcgattattatatccgggtttacaagccgatggataaggctggttcttatggtatacaagagtggataggtttcattggtgtccgtggtatttcaggtagttacttcaatgtgatggggcttcctgtacagcgcctgtacacggaactgaaaaaactataagtcagtatgtgaacagtaggggccgtgtttttgttatttatatgaactataaatggaaaaacaattatggcttataaaatagctttttacgacacgaaaccctacgacgaacgctcgtttacggaggctaatgagaagtttggctttgatatcaggtattacaaaggccatttgaatatgaataacgtggtgttgaccaaaggagtggatgtggtttgcatcttcgtaaacgatacggctgatgccgaagttatccgggcaatggcggataatggtgttaaactgctggctttaagatgcgcaggttataataatgtggatttagcggcaacggcaggtaagatgaaagtggtacgggtaccggcttattcaccttatgccgttgccgaatttacagtggcgttgatgttatcactcaaccgcaagattccccgtgccacaatgcggacacgtgacgggaacttctccttgcacgggcttatgggatttgatatgcatggcaagactgccggaattatcggtacgggtaagattgccaagattttaattcagatattacgtggattcggtatgaatgttcttgcatatgatctttatcccgattacaattttgcccgtgaacatcaggtggtttattgtactttggatgaactttatcatagttcggatatcatctccctgcattgtcctttgacagaacagacaaagtatctgattaatgattattccatcagtaaaatgaaagacggagtgatgattatcaatacggggcgtgggcagttgattcacaccaatgccttgatagagggactgaagactaaaaaggtgggatatgccggtctggatgtatacgaggaagaagagccttatttttatgaagataagtccgacaagattattgatgatgacactttagcccgtcttttgtctttcaacaatgtgattgtgacttctcatcaggcattctttaccaaagaagcaatgacgaatattgctcatactactctgcaaaatgtgaaagactttgctgaaagtagatctttggtgaacgaagtagcggtggggagagtctaatctcccctgtagtaatataataaggagtggcgggctataaagtccgcattcttttgaaccagttccctttcaccaaattcggggaattgtgcatcggggatatagtggttgtttattacatattccatcaggtccggtgggcatttggtcgggatagtaagcaggctgaatgcctcttgggcagccgttgcggcatcatacatcgggttaagagggtcactgatgtatttgcatatatctttcgccagtagaatacctttttcggaattcaccatcatgatgaaatccttatgttccttcatttggggcaaagtgtgattggaatcgtccggccattgtaatacttgggtaaggaaacggtgtagttccttatatccttccagatatacgatacgggcaccgtttgtgccttgcgtgaacaattgataggtatggtggttcctttccttcatttcatccgatatttcgggaatggcagggtatagtccttctatctcttcccaacattcggtttctccgttggtcagcaggtcaatccattcatgaagaaacagggcaagggggccacatggaatgatgaatttgtcggtttctgtaacttgtgcaatatattcttgtacagatggttctgtgagataagtgtgtccgaacagccagcgtagtttatggtttgcgttctcttttcctttgaagtccataaagaaatcctgtaacgtgtcattggcgggagccgtttcatactcttcatccaatatccggaaaaatgaatgcgaggtttcttcgatattcctgtccatcggattgatatacggatgtttatatggagccttctctaaagtgttccaaatgatgaagcggatatcttcttcattgatctcatcttttatataatccggccggatggtatagaaaggaagtgacgtatcatatagttccagatgttttttgatgaatgcttgccatagacctaaacctgaaatgacatcttcaaaataggcagcggtgtaaagacataatttcttttttatggattcgggaatctttcttatcgtacaagtggagtataatcggttagccagatcgacaaaatatctgtctgtagcctgttgttggatgtaaggatggatagccaaccaatcttttatgtataattttatggtttgcatattagtttatttgaattatttttattgcaaagatattcctttcattgtaaaaaggaaggagaatatcgggatatttactttatctttgcaatattctaactttgaaatacctataaaaatggaaatagatttaacaactcctgctttattattttctgccatatcgctgattatgttggcatatactaatcgttttctttcatacgctcaattagtgcgtacgttgaaggaccaatatcgtgagaatcattcggctgtgacagcagcacagattgctaatctccgcaagcgtctttatctgacacgtgccatgcaggtgacaggtatcggaagtttgttgctttgtgtggtcagtatgtttttaatgtatatacagttctaccttatatccgtatatatttttggactggcgcttgtgctgctcattatttctttggggatttctgtgcgcgagatttatatttcggtcaaggcgctggaattgcatctaagcgatatggattcctgatctatttttttgagaagatatttatcataaaggaacaggttgccagtgtgatacctgttcctactactccctgccatccaaaccagtgccaaaatattccggcaagaagtgtacctatggaaccgccaataaaataggtcgtcataaaaatggtgttgatacggttggccgccttcgggttaagagagaaaatcgtagtctgattacttaactggatgcattgcatgcctatatctatgataaaaattccgatgatgattcccacataggagttctgaccggaataaagcgagaaccacgctgcaaatatcaaaccacaaccgatgtaattcagtcgtttgactcccaaaacctgtacatagtttcctatatacgaggcggtgagagctcctgctatgccgcataatcccaataaccctacaatgttgtttcccgcaaaaaaaggggcttgttccatcttaaatgccaatgaagtccatagagcaagaaatgagccgaaagcaattccggcacgtaaggaagaaatacgcaactgggggtattccataaccaatgaaaacaaggatttcatcagatcactgtatctgcctttgaaattacacggcatgtcgggtagtacacgcatgatgatgatgacacatatcaccatcatcccggctgccacaaagaaaatgaaccgccatcctaaatattcaccgataattccgcttactacgcgcgaggccaggatacctgtcagcaatcccgatacaatcatacctacattttttcccttggtttcgggagtggaaaattgggcagctatggggataaagatttgtggcatcaccgaacaaatgccggtcagtagagaggcaaataaaatgagatggatatagggagtcagtgcgatggttagtaatgaaacgaccaagactgtgaaattgattagaataatggttttccttttaaataaatctcccaaaggaataatgaacagcaatccgatggcataacctatttgggtaatcattgctatcaggttggcggtgaactcggatgtttggagatcacggctgatgcggtttaataaaggttggttataatataaattggcaacggagattcccgcaataattgctagcgtccaaagtaaggaggcaggtagtccttggttttcttttaattcttgtttcatgctgcaaaaatagtaatttcatgaaaatcatgttatctttgtaaagaagaaaaatggaaatgaaaatgaaaatggaaatgaagaattggataaaaacagtctgttttctgttttggacctgtgtaatgtgtacggcgtgtattgatgatgatgtggaggaaggtactgttgatttacaaacaggagagagcattcctgttttctctgtggtaatggatgatggacaaataataacttccgaaactctgaaaggagaggtttctttgattgtgttttttcatacggggtgtccggactgccggaaagaacttcctgtgctgcaaaaaatatatacggattacggtcgaagaatccggatggtttgtattagcagggaagagagctcggcagagattgtccgttattgggacgaaaatcatttgaccttgccctattcggcccaagaaaaccgcacggtatactatcagtttgctaaatcgggaatacctcgtgtttatgtcatagataaagagttggttatccgtagtgttttcacggataacccgttggcaagttatgaagatttggctgaggctataaccgccagtttgtaattttaggcatggtattttaatttatattatttcttttggtagatggtgtatgtttatagcatacttttccctgttcatctttagggataatgaatgtggttgatgaagatattggtgatggagtatcttgatgtttattgtgttggctttttgaaaaaagttcctttattgtctttaatctctatcattccattatcggcatcaaataggaaaggaggaaagctgaaaaatatgtatatttcagtatcttttaatttatagagtttgggagttatttttttgctgacaccagatgggaatacttggtcatccatttcggtgaggatataataatctgctccctccctcaatacatttttgctaatcttggcttctgcttttgatttggcaataatatagaatccctctatatcatatttttcccaatttttatactcttgtccaagcaccatacttatgtttaaacataaaaccagtagtaataatattcttttcatatctatctgtttttaaggttattccaagttggtatcacaaatataagaattcttattggttttttcaaggaataagaaagaaaaatagagagtggaattttaaagaaaagtaattcctatccatatcagaactcctgctattagaacaatgcctaacatgattaattttattttgaagagctggtgggtttccgcttcttctttttcttgcgtttttattctgatctcttctaattgctcaagggatagatgggaggagtgcccttttttgttcaaatcaatcagtcggtttctagtttcattcaagcgttcctttcctgcctttcgtagttcacgattttctttatctcttctcatcatgtcattgatgcaacctaaagtacccataatctaactgtttaatttgaattcattttcacaaatatagtgttttttgcagttgcttttcttcatttgctaatttaatatttgaaggatagatattacttaataaacctgatgtgccttgactgccggatataaatattctgccaatggatttgtaatataaagttgtatgccattatgctttcataccattgcttatggggtaatatgttgataatgaactgtatttatatggcgtggcattttccccattgaaacaggtaaaaagtagatgtatttatcttatcattgaaaaaaaatgtgaatataaagtttaggtgaaagtgattttatttgtaaattgtataccgtcatgtaggtatctccgatctatgtataatttagtatatacctagaaatggggattgtgccgagcttttatgaattgtaattttgcaaaccaatagagaatgaaatgatttgtaagattgcatatatttttttatttataatttgtagcaatgtgtctcttttatgggggcagacatttgtatttcggggaactgtactggatgagcagactcataaagcgttggattacgctacagttcaattgtttgtggataagcagattgtttatgggggaataacagatgcgaatggacattttgaacttctacatatccatcctggaacttatcgggttattgtatcctatttaggatatgattctacagaaaaagaagtgaaggttattggggatatttcagcaatcttttatttaaaaccttcggtcatggcgctgaacgaggtagtggtgaccgcttctgaatcaaaacgcgctaccagcgcttctatcgttgaccgtacagccatgaaacatcttcagcccagcagtttcagtgacttgatggaattagtacctggaggaaagtcggctgatcctcagatggggcaggccaatctgatccggatacgtgaaacaggtaagacggaggatatctcttcattgggagttggattttatattgatggtatctcccagaatacggatgcgaatctgcaatatatgccaaacagtacttccgcagtgaatgcaacgagcacaatgtcaaaagggatagatatgcgtaccatctcaaccgataatattgagaaggtggaaatcattcgtggcattccttccgtggcttatggtaatgtggcaaacggtgcggtaatcattcagcgtaaaatgaatgagagccccttgtctgcgcgttttaaggctgataaaaccagtaaactgttttctgtaggcaagggaattcggctggatgggaacgggcgttatgtgttgaatgctgatttaaactatttggagtccaaaatagatccgcgtaacagtgtgaaaaattacactcgccttactgcttccgcccgcttggatggcaaatggttatggaatgaacgtaatattcattggaatatcagttccgattataccggctcgtttgatgatgcgaagagggataaagatgcgacagtaaaggaagattcttataaatcggactttaacagcctgaagatagcggggaaatggagcatgaagtttccggcccatttatggattcgtgaggttggtgtggctacttctgtcagtcagcagtgggagaagatgcgtgaaataaagtccgtttctctgaatcgtccggcagctattgctactcagacagaaaccggagagtttgatggcatctatctaccttataattatgtggcacagatggatattgatggtaaacctttatatgttacggcttccgcccgtacgcggttggctttcccgttgggggtattacagaatgcgatgaatatggggatggaatggaattatcagaagaatttgggagaaggccaggtattcgatgtgacacggcccatcagtgaaagtttgagtacacggcctcgccgttttaaggatataccggagctgcaacctttcgccttctatgccgaggaggtgttgaatcttcctgtaaatagacataaattggcttttacggctggtatccgtttgcagtctttattggggctggacactaaatataagatgcagggcaagatatatcccgatcttcgtctggacttgcaatggagtttaccggtatcaaacggatgggatgtttccttttcgggaggtttgggctggatcagccgtatgccgaccaccgcacagctatatccggattttaagtatgtagatttgattcagttgaattattaccataccaatccggattatcgccgtatcaatatgatgacatataaatgggataatacaaactatcaattggaaccagcacgtaacatgaaatgggaagtgcgggccgacgtcagctataagggaaaccgcctgtcgataacttatttccgcgaacggatgaataatgcttttgatgatatcacttattataggtcattggcatataaactatatgatcctgctagtatcgacggatcagcattgacggctcctccagaactttctcagttgacttatacaaatgaatataatctggatgtgtattccacacaaggtaatgtaatgaaggtgtgtaaagaaggagtggagtttcagttcgcttccaaacgaatagaatcgctcaagactcgcgtcactatgtatggagcctggataaagacaatttataattcggattctcctcaatataaggcctcttctatattgttggacaataaacagctgaaatatgtgggattgtacaatggggacaacggaacagaaagccaggcattcaatacgaactttatgtttgatacctatatacagcgtttgggacttactttctctacgtcggcacaatgcacttggtataccaacagacggaacttgtggaataatggcgtgccagtaagctatatagatcaatccggcgaaacgcatccgtttcgcgaagaggataaaaacaatattcagttacagcatctggtggagaaatattcagccacttattttgagcgtactaccgtgcctttttatatggatatcaatttgaaggcgagtaaacggatcggtaagtatctgaatctggctttttatgtaaaccggcttttgggtatttatcctgattatacgttacggggcgtactgcaacggagaacgtccgaatcgccttatttcggtatggaaatgaacttaaccttttagtaaatgaacaataaaatagagatgaagatgaaaaagaatcaattgacaatgttagtcctttttgtgacaatgctgggatttaccgcatgtagtgatgatgacaaagtgagcatatccactgtaggtattaccactactgtagatacaactatcgaggggctgcaactgaccggtggaacctatacttttgaaaatgtaaatacatctgtcaagacagacattacctatccggctcagagtattgaactggcggacgggttgtataatgtaactttcattggtaagggaacttactcacagaatggaactccggtggaagtcgatgtacagggagtacaacagaatgtggccgtatctggagggtcgtacaagctggaactgaaggttcatgtactcaatacaggtgatcctgattttgtgattgccgagatatttattcccggaacctataatgaagcaggtaagcaatataatggcgaccagtatatacgtatctataataactcggataaagttttgtatgcggatggattgatatttatggaatcacaattccaaactactcagaaatatcaatcggtagatccggatatcatggatgaagctattgcggtaggctctgttgtagcagtaccgggcagtggaacagattatccggtacaaccgggagaatcctttatcctttgtgacaatgcgatcaatcataaagaggctaatccgaattctatagatttaagtaaagccaattttgagtggtatattgaatcaaagcaagatgtggataatccggctgttcccaatctagatgtttattattgttattccaaaactatctgggtgttgaataaacagggaaatcgcgcttatgctattggcagattacccaaaagtatgactaaagaaaagtatatttcagactatgcatacaactatacgtatattatgcaaaatggaacagtcagtaaaccgcaaagcaaatataagttccccaatgaatgggtgattgatgctgtaaatgtaggtgcttccaatgaatggcagtggaatgtaacctctaccgggctggatatggggcatacttatatcggtatgaacaataccgttgcagaaaacatcggaaagtgcgtaatgcgtaaagccgcctacaaggatggtgatcgggaagtattgcaggatacaaataactctaccgttgatttcacacctgcggctactccgagcctgtttaacaaataattgaatccgtcttattgatatataaatctttattattcatgatgctaatccgaattatcattatgttgctgattgctttatttgtggagagtcggcaggaagccttcgggcagactaccgacacactctccctgtccgataaggtaatccgtaccgcttcatttgcgactggatttcgtggcgagatatggcagaatccggcactttattattactatactccgtatatatggacaaggctggacgtaaatggagcttatcatgataaaggaaaagcatctttgaaacaggaaggtgataaggatacccgtatcggggtagatgtcaattccttcgttattctttcggaacgtgatcgtgtattcggttcagcaggatacaggagtgagaagcaggagaatgtgttatggaatgaaaatatagactggaaattgatcgctccttacgtgactggtgattccattggtggtttcctgaagggagaaacttattatttcaatggaggttacgccagtgagtcaggttcctggacatggggaatcaccggtggttacagagcgtctcataattatcgggataaagatccgcgtccacgtaatacagcttccgatctctcttttgctttgggagcaggatatcgtctggggacatatcgtttgggagtttccgcagatttccggctttatcagcagaaaagtgagatttcattccttgcagataaaggctctacttcggtataccatatgttgggattgggcatggattatgtgcgtttcgccggaaaccagaccgggacgaagcatcaaggcatccggtggggaggaagcataggcattctgccagttgatacggaaaaggggatatcggccacagtttcaattgaccgtatgtcaatggacaagaaattgagcaatgccaataatctcactttgctggaattgaatacgactgatttgaaaggaaacgtgacctggatgcgggaacttcagcaggcagaacaccttgctgtgaaactggatgcaggctatatagttcgtaaaggaatggagaatatttacggagaggcgggcggaagctcctatggagcattaattagtacatctccgggaatgaaggtcacgaatagtcggattgccgtaagtggtttgtgggagaaacttttgactgataaaggtgtatggggaggagcaattgtcccaaacataatctaccatcggttggaaacggattacaacgccgtatcccggtttgttcacttgtctgttttggagagttctttgcgtgcccgtttgctgtatcagaagaggctgctacgattgaccgcagaagctaacggtggatattatgccaatttatcggctgaatattctttaccgggattgaataccgcgaagtcgtccgcccagactttattggcaaatattgactatttatctgatagttatagtatggtggggattcgtctgcaaggggattatcccatcatgaaacaatataacctgtctttgtctgttcaatggcaggcggcatattataaaaaatgcggaacggcccagtatgccgtttgttcattgggcatctttttttaaaaaataaaaacaattagcatatgaaaattaagtttatggtcgctgcaaccttaatggcagctttagtaactactacttcttgtggaaacagtaacaaacagagccagtctgaaaaaacggagcaggcggctccggcggcattgagcatcgataatctgctggtgcatgccgattcactggccaacaaggaggtgactatcgaaggaatctgcacacatacctgcaagcacggagctacaaaaatattcctgatgggcagtgatgataccaaaacgattcgtgtggaagccggacctttgggctcgtttgataccaaatgcatcaacgctattgtcacagtgaccggaacgttaaaggaacagcgggtagatgaagcttacttgcaaaactgggaggctaaactgaaagcacagactgaaaaatctcatggagaaactgctgccgggtgtgattcggaaaaaaaagcacgcggtgaaacagccagcacccctgaagcccgtattgcggactttcgcgcaaagatagcagaaagaaaagctgctaccggaaaagattatctgtcattctactatatggaagccagttcttatgaaatcgcagaataaaggtactgcattccgcaagtggagccggatcatccatcgtgatctgtctttcttctttgcgggaatgattttgatttatgctatttcgggtatcgtgatgaaccatagggatagcataaatccccattatacagttacacgaacggaatataaaataacagaggatctgtcggacaagagcaaagttaatgagaagatgattttgactttgttggaaccgctgggcgaagccggaaattttactaaatattattacccggaaccggatctgattaaggtttttctgaaaggaggctcaagtctggtgattaacacccggacaaaagatgctgtctacgagggggtgaagcgccgtccgctgatctcttccatggtacaactccatttcaatccgggtaagtggtggacttggtttgccgatgcttttgctgtctgtctgattattatcactgtcagcggtatagtgatgataaaaggtcctaaaggattgtggggcagaggaggaatcgagttggtggccggtatcttgattcctattcttttcctggcgtgtttctaatagcaaacgaaaaatgatttataaagcatgagtgcaattatagaatgtaagaacctgacccattattacggtcaacgcaagatttatgagaacttgagttttgaagttcctcaagggcgtatcttggggttgttgggtaaaaatggtacagggaaaacgacaaccattaatatattgagcggttatcttcagccgcgttcaggcgaatgtcgcatctttggcgagaacattcagaccatgaatcctgctttacgcaggaatatcggtttattgctggaaggtcatgttcaatatcagtttatgaatatcacacaaatagaaaagttttatgcttctttttatccgggacaatggaaaaaggaggcttattatgacttgatgaataaattgaaggtagctccggggcaacgtatctcaagaatgtcgaacggacagcgttcgcaagtggcattgggactgatcctggcacaaaatccggagttgttgattctggatgatttctctttaggacttgatccgggctatcgccgtctttttgtggattatttacgtgattatgcccgttccgagaacaagactgttttcctgacttcccatattattcaggatatggagcggttgattgatgattgtattattatggattatggctctatccttattcaacagcctattgaaacgttgatgaaagagctgagaagatatacttgtactgtgcccgagggttatcagcctcagttgccggcaacttgctatcatccggctgtcattcgtcaaaccttggaaacgtactcctttttgcctcccgtggatgtggagaaactgttgaaggaaagtcaagttccctttactggtttgcagcacgaaaatgtaagtctggaagatgcctttatcggtcttaccggaaagtattaatatgtaaactaaatagaagaaatatgatacaagccatattttataaagagtggataaaaacgcgttggtattggttgctggcaactctttttatgatagggatcacaggatattccatgcttcgtattggccgtaccattgccatacagggaatcgatcatttatgggtagtgatggtccagaaggatgctatatttattgatttgttgcaatttgtccctttacttatcggtatcttgcttgctgccgtacagtttttccccgagatgcaacgtaagtgtttgaagcttactttgcatttgccttattcacagaagaaaatggtcatgtcaatgttggcctatggcgtacttgcactggtgacctgttttgctatgagttttattatgatgggagtttatctgccacaacattttacaagtgagttggtgcagcgtgttttattatctgcggctccatggttttttgccggatttgccggttatctgcttgtttcatggatttgcctggaacccacatggaagcgcagggttttgaatctgattattgcggcattgattttccgtgtctactttctggctccgggagcggaggcatataatagtttcttgccctgtctgacactttatacgttgcttgccgcttctctttcgtggatttctgtggtacggttcaaggccggtaagcaagactaattgaatgtttattattaaaaaatcaaacaaacatgattcgattcagcaaaatatttttttatattaccgtagctgtcctgcttgtatggcagttgccttggtgttatgcttttctcacactgaagcctgtcaaaactccttttactatgtatagttccgtacttggtgattttgttattacacaactagatgagaataagcaacttcaccgctatgatacgaaaggcaatacatatacacaacagcaggtagacagtttgttgccttctctctatgtgcgccagcttacggcggacgaacgtttccctgataccatttgtggtaaggcagttagtccgaaagatattcaattgacaaactttactttcaagagtgtgccgtcagccatcaatgctccccagacaggactctattttctgatggagtccatgtccaaacgggtggatttgaaaatgcccgaagatgcattccgttttaccgataaaggtatagaatttattcgtatggaaacgaattgtatcgatgaggcgaaaagcaaattgtttacggatatgctggttcagaaagggtttgcttttcctgcatgctatgcttcgggcaatccaactactcgtaaagactatgatgagggatatctggttttagatgccaaccataaattgttccatctgaagtgcaccaaaggacgtccgtatgtgaaagctattcagttgcctgaaggagtcttgccggaatatgtgtttattactgaattccgtagccgtcggactttggggtatatggtagatagcaagcatcatttttatattatcaatagtgatggaagtttggtgaaatcagctctccccggtttcgatccggcaaaagatgagttgaccatctttggaaatatgtttgactggactgtaaagttatcgacagataaagatgattattactatgctttggatgctacagattattcactgattaaagaacatgcctataaagatatccgccgttctgttccggggttgtcttttacatctccagatgacaaatttgtaaaacctcgtttttgatgtgaatttggcaggggaagtctgatattaaaatgtatattagttcgaacagaccgaaaacaactaggtaaaggggctatcatgttaggcatcagctaactctaccttctgtgagatactgcaaatacgggattatataattgtgcggacagacaggagggcgtgaaaacagccttcctttttttgataatatttaagatacagggatttgatctagtttttcttgctcgtcaattttatattatgataatcgttctttgagtatatgcaggataaaacaggttgttgaattttgcttgtttttaaattttcaaaaatgccagattgcatataaataatcttcgttttgacctccttttatcctaaaccaactcttaattgtataaccgatttatgatttaaagaaccaatttcattccgtaattttagacaattatttgcaatacttttgattgatattgaaaaataggagggggtgggtcatcagttaaacgaatgaaattactggaaataaaaatccctataactgcaatggttatagggatttatatattagcaatgtattatattacttgctcaaagcagtagctacgtcaaccgcacaagccactgtacatcctaccatcgggttgttaccgatacccaggaatcccatcatttccacgtgagcaggaactgatgaagaaccggcgaactgagcgtctgagtgcatacggcccatagtgtctgtcataccgtaagaagcaggaccggcagccatgttgtccgggtgaagagtacgacctgtaccaccacctgatgcaactgagaaataaggcttacctgcaagaacacgttctttcttgtaagtacctgcaaccggatgttggaaacgagtcgggttagtagagttaccggtgatagatacgtctacaccttctttccacatgatagctacaccttcgcgaacatcatcggctccgtagcattttacttttgcacgaggaccgtcagaataagcgatttcacgaactactttcagttcacctgtgaaataatcgaattcagtctgaacgtatgtaaatccgttgatacgagagatgatctgtgcagcgtctttgcccaaaccgttcaagatacaacgcagaggttctttacgtactttgtctgcttttgcagcgattttgatagcaccttcggcagcagcgaatgattcgtgacctgccaggaatgcaaaacatttagtttcttcgcgcagcaacatagcagccaggttaccgtgaccgatacctactttacggtcgtcggctacagaacccggaatacagaatgcctgcagaccgataccgatagcttcggcagcttcggcagcgtttttgcaacctttcttcaatgcaatggcagaacctactacgtaagcccacttggcattttcgaaacagataggctgagtttcttcacaagttttataaggatcaagtccggcagcttcgcagattgcgttagcttcttcgatgtctttgatgccgttttcgttcaaagcagcaatgatctgtttgatacgacggtcttggctttcgaattttacttctctaatcatattctttcctccttataattattcgtgacgtggatcaattttcttaacagctccctgttcttcagttacacgtccgtaagtacctgtaactttcttcaacgcttcgttagcatcagtacccttcttgatttcgtccatgaacttacccatgtgaacgaattcgtaaccgcagatttcgtcgttcttatccaagaatacgttcttgatgtaaccttcagccatttcaaggtaacggggacctttagccaaagtaccatacaaagtacctacctggctgcgaagacctttacccaagtcttccagaccggcaccgataatcagaccgccttctgagaaagccgactgagtacgtccgtaaacgatttgaaggaatagttcgcgcattgctgtgttgatagcgtcacaaaccaagtcggtgttcaatgcttccaatacagtcttgcccggaaggatttcagcagccatggcagccgagtgagtcatacctgagcaaccgatagtttctaccaatgcttcctggatgataccttcttttacgttaagggttagtttacaagcaccctgctgaggagcacaccagccaataccgtgtgtcaaaccagagatgtctttaatttcttttgattttacccactttccttcttcaggaataggagccggtccgtgattgggacctttcttcacaacacacatgtgttctacttcgtgtgaataagtcatattctttacgttttttggtaataaaataaatattcgtaaccacgtgaaaagattggttattcttttcgcctacaaagttagtcgttttattcttttctgcaacttgttgcccgtcactttttatctttaaataaaataaatttattgcaggacagcattttgcaaactagagttgccaaaatgttttttctttccgatgaaatttctatctttgtacctatattataatgataggaatggaagcaaataaaatagcaattacggacgaagctttgcgccgaggtgcggaagagggcatggatggtttcttgaaggtgtttatagataaatacctggaggtgacaggaggtgttgtcaatgcggaaacaatgcctttgctcaatggttaccagcattcattgttggggtatcatttcttgcgtgaagaaataaatgaaggtggttttgtacaattgatacagaatggttttggaccttatatctttgataatccttttgcaaaagcaatgcggcagtttggagcgaaagaatttgccaaattgatttatagcgcgaagaaaatatatgatgagaaccgtgctgatttggaaaaggacagggatgatgaggaatttatggcaatgtatgagcaatacgaggcctttgatgagttggaagagcagttcatggatatggaagagtcggtaactgcccggattgcagaatatgtggacaatcatattgaggagtttgcggagattgtatgacaaggatttttgcgtactttgtcgggtataagctcatgcgttttgatataaaaaaagtaagttggcttcaatagctaagtaagatacgttcgttggctgacgaacctatgttgcttggtcaagcaagttaacttacttttttgtcttgttattccggtgtcattccatttattgtttcctgataaaccaacctttgatataggcggttgccagtacggcaagtcctgccgccaggcagattcccgtaaacaccagcccgtaaccgttcaagaaagctaccggagcgaaagttatcagagaaatctctaccggggcgatgaacaagtaagccagtgcatagttatccaggcatcggctgcgcattttggggtctgcaacgcggagcaatgcgatgcccatagccatagttcctgtaaaccatccccatgtgaagatagctttctcgaaccaacattctttcattagtttgcgggccatgaccagaacataaatcagagttgcgattaatcctgagactaacagaattaataagggtatgatgtactctattacaacagatattttaatggaagcaattccaaaagctaccagaaaatcggtaaaggctccgctgatgtggcctatggtttgcgggcagacataatcactggttcttgttttgtcgaatatctttttgatgaatatacctaccacaaatgcacaactgaataccggcagttcaaaccccggcataaagtgggatactgttttgctgatgcagtatccgcctaatgctatcactgctacaatgataagattgaaggtcagcgggtcaatggagatggaagagcaagaactttcacccatgctttcccgtttgtcgccgggcaacaggcctgtctgtaattcgtgaggaaggtcatcgtaattggcgaggaaggaggtgtgccctttctttgtcccccattttatgatgatcagtccgataatgactgccgctacgataccgaaggtggcggcagtcatggccaaagttagaatttcgtcatatccgaactggctgaaagcctgtccgatggctgctgctgtaccgtgcccgccgcaatagccgcttggcatagtgatgccgaaggcagggttcaagggccatatccggttcaggacaagcaatcccaacagtcctccaaaagcccattgcaacaacattcctgcctgtgaatatgcccacatgctgcctatattgtctgcatctcctttggctgccttttgtgaggtgagggggagagcgccgaaaatgaaggctatcaatatgccggcataagttcctgtttgggtggaaagaggtatgatgccgaaaccgtgaggtcccaaggacagtcctataaacccggccaacaggctggggggaatgaacagcctttggatgaatcttatttttactctcatgagtttgccgagcagtagcagtactgagatgatgcctgtatcgacaaagagtgtccacggggtgaaatcggtcataaatctagggcttgtttggatgtattcgttgaagaatacagcgttcataaatagtttattttaccgaatcggtaggaatggaaattgatcttatcggcaaaaataatgtataggtatcatgtaatatcttaggttttattgttattaagttgttttgtttcaaagataggaaataaagtggtactatagcccaactgcttgttcttttatatgttaatttttattaatgggttaatggcggataggctacaagtaaatttcggtgaaaaaaatagttaaaacaaaagataaagcaagtcttatcagaggatgaaacatgaataaaaaataatgttaaaagacaagtggcgacgcagtatttaagccaatttttcatttaatcattaaaacaataaaaagaattaagtttctttcttggaaaccgattcttttatttaattttgcaaaccctaataattataaagaagaaaatgaaaaaaatgaaattggcagcaatatttgctgggttagtatcggtgtttacttttagttcttgtttgaatgatggtgatagcggccccaattatgatctttatgagatcgttactgtggaagatggtagtatttttggtggacctgtcctgaaaggagatgcatggggatatacttatactccagtggcttcaagtgtattggccggtcttaaggcatctgatggcagttattacaagcgtgtgcaggtagggatcaaactgatggaaggagaagcgattacagaggggaaaaagtcttataaggtaagtgaggttggcctaatagctattttgaattataaagattttaatgttcaggctgatacattgaaaaatgagtatgcactagtgtcattggaggattctaataataagatatgggctataaatggatatgtcaacgtaccttttacctttaaaactaaagaacagctgaacatgaatgatttccatttatatgctgtagaagccaaggaggatacattggtgacaagacttcgacagaccaaaggggctgatgatgcttatcagacaggaggtgctttgattagtttccatatgccttttaatgatatggaatttcgtgacattttcgatcaagtagtgcctaagagtgatactattgtagttaaggtgactgcaaagggagaaaatgacaaagaacttgtttctacagtgaaatgtagtgcttcgaatatgcaaggaagttattaataatactttattatatagtgaaatccccttcagttacggttgaaggggatttttatttaatggaactatgtggttcaatttataagataaggggggggaagaaatttgacggggcctacttcttattttcctgttcatatctttctttagattcagtatatacctcctgcgtgtgaaaagagttgacatgaattttaaacggttcgatctttctgctgccgtaataacaacatatcacattcgttcctgttgcataagccttttctcttccctgattaagcctttttatacggatgtattctatctccataagctttggagttatctcccaaggctatggagttaactcccaaggcttgcggagataaaacaaacaggaagaaaacccttaaccatggggcaggaaaggtttagagatatggataagatcttttaaggatgaatctgattataaaactatgcattccctatggagagaaagttcccagacatccttcttctgaattagcgtttgttttttatattctaaagctttcaatgttttttctttagtcatatttccttagttatatttgtctttcttctgaatctataataaaagtaggcttatttttttgattcccccaagagaagtatgcgtttttttattcgtttattccagtgaattaattacctttgcatttcattgaagttgaactgaggtaaatagattaggcattgaattacaaagatttatttaagcgagtaatatcgctgatttcatctccggcaaaagcatgggaggaaattggcaaggaagaggataggcgtaaagtgctgggagcatttgtttatcccatgataggtttatgcggattgtccgtttttataggtacattcattgggaatacggcaggggtcgctgctttccagatagcaatgacacgatgttgtgctatatttgtatccttgttcggaggatattttttggcggtatacgccatagaccagttgggcaagaaactgttaggacgtgaagaccagtatgaactaaatcagcagtttgtaggttattctatggtagtgacttttgtgctcgatattgtcagtgggttgttctctatttccattctccattggatattgcaattttatactatattcgtggtgttcgagggggcgcgtaccctgatgaaggtgaatgagacgaaactgacacgatacaccttgattgcttcagttattataattgtttgtccggcattgattgccgctgtgtttaatgagttatctgttattttaaattaatgaaaccgactcctattaatataaagaataagcgtgcatcgttcgattatgaatttatcgatacgtacacggcaggtatcgtgctcacgggaaccgagataaagtccatccgtttgggcaaagccagtctggtagatacctattgttattttgtgcaaggcgagttgtgggtgaagaatatgcacatagccgaatacttttacggctcatacaataaccattctgcccgtcgcgaacgtaaattgttgttgaataagaaagaactgcggaaattggaagaagccggaaagaaccccggttttacgattgtccctgtccgtctgtttattaatgagaaaggactggcgaagctggttgtcgcattggctaaaggtaagaaacaatatgataagcgcgagtcattgaaagagaaggacgaccgtcgcgaaatggaccgtatgtttaaaaggtaagtgaaatccgtgttatccgtaccccaaaaatagacttatggctacattaaaacaactaattgacgagagagttctcattcttgatggtgcaatgggaactatgatacaaaggtataatttgtctgaacaggatttccggggagagcgttttgctgagatgcccggacagatgaagggcaataatgacttgctttgtcttacccgccctgatgtgataaaggatatccaccataaatatctggaagcaggggctgatattattgaaacaaatacgttcaatgcccaatgggtttcgatggcagattatcatatgcaggatttgtgccgtgagattaatctggcctctgccggacttgctcgcgaaatggctgacgaatataccgcgaagacccctcataaacctagatttgtagcaggttcggtaggtcctaccaacaaaacttgttccatgagtccggatgtcaataatccggccttgcgtgctttgacatacgatgaactggccgctgcctatcaggaacaaatggaagctttgctggaaggaggagtggatgcgcttctgatagaaaccattttcgattccctgaatgccaaagcggccatttatgctgcggaaacggcaatgaagaagatagggcgtgaggttcctcttatgctttctgttactgtttcggatattgcaggacgtactctttcggggcaaacattggatgcttttctggcatccgtacagcatgcgcctattttttctatcgggctgaactgctcgttcggagcgaaacaattgaaaccttttctggaagggctggctgcacgggcaccttattatataagtgcctatcccaatgccggacttcctaacagtttgggacagtatgaccagactccggaggaaatggcttcagaagtgaaggaatatatcgatgaaggattagtaaacattatcggtggttgttgtggtacaacggaggaatatattgcaaaatatcaggaattgatcgtttccggttctgcctgggtatctcctcatatccctgccaccactcctgagaggctgtggctttccgggttggagctgttggagcagactcccgaaatgaattttattaatgtaggcgaacggtgcaatgtggccggatcccgtaagttcctccgtttaatcaatgaaaagaaatatgaggaagcgctaagtatcgctcgcaagcaggtggaagacggtgctttggtgattgatgtaaatatggatgacggtttgctggatgcccgggaggagatgactactttcttgaatctggtcatgtccgaacccgacatagcccgtgtacctgttatgattgactcttccaagtgggaagtcattgaggccggactgaaatgcctgcaaggaaagtccattgtcaattctatttctttgaaggaaggggaggagatatttatagaacatgcccgtctgataaaaaaactgggagctgccgttgtagtgatggctttcgatgaaaaaggacaggcagatacttttgaacgtaagattgaagtctgtgcccgtgcttataaaatattgacagaacaggtggattttaatcctcatgatatcattttcgaccctaatgtactggctgtggctacgggtattgaggaacatgataattatgcggtggattttatcaaggctaccggatggatcaaaaagaatttgcccggtgcacacgtcagtggtggcgtgagcaacctgtcgttctccttccgtggaaataactatatccgtgaggcgatgcatgccgtgtttctttatcacgctatccgtcaaggtatggatatgggtattgtaaatcctgctgcttcggtgctctatacggatattcctgctgatgtgctggaacggatagaggatgtggtcttaaaccgtaggcccgatgcggccgaacgtttgatagagactgctgaggcgttgaaaaatacggcgaccggaacagaagcggtgaaacaggatgtgtggcgtgaagaaccgatggtagagaaacggcttcagtatgccttgataaaaggcattggcgatcatttggaagaggatttggcagaagcggttaaactgtatcctaaagcagtggatattattgagggtccgctaatggaaggtatgaataaagtcggagaattgtttggagcagggaaaatgtttttaccgcaagttgtgaagactgcccgtaccatgaaaaaggcggtagcgattttgcagccgctcattgaggccgacaaacaggaaggcgtccgcagtgcaggaaaagtattgatggctaccgtaaaaggggatgtgcatgatattgggaagaatatcgtatcagtggtcatggcttgtaataactatgaaattatagaccttggcgtgatggttcctgccgaaatgatagtcaggaaggctatagaggaaaaggtggatataataggattaagcgggctgattactccatcattggaagaaatggcgcatgtggctgtagagttaaagcgtgcggggctggacattcccattatgattggaggagccactacttccaagctgcatactgccttgaaaatagcacctgtttatggaggtccggtcattcacatgaaagatgcttcacagaatgccttggtagccgcccgtttgctgaatccggaatcttcttctgagtttgtggaaaggctgaacaaagaatatgaggatcttcgtctgaaaaacagtgccaggcaggtaaaaacggtatctttggaagaagctcagaaaaataaattgaacctttggtcataaaggagtgcccccccaaaaaaaagttagacacaaaacttttggggggcacttcataaaattacgactttttttatctgcccattttattcgaaagaataagaagctgtttgctagcaaacaaaacagtatcccgcctgaaataacccattatttcaggcgggatactgttttatgttatggatatatttctaggactgcttagaatttactgagaaactcttccgctttttccaaattttcgggtttgccgatatcaagcaattgcaagtcatcttctacatagcactggatgtcgaccctgtgacatatggagagatagaaatcgataatggaatattttcctttgggaaggagatgtaaaattttaggggtggtcacttgtattccgctataggcgtattcctggtattccccttctctataccggaatcctgccggtttggtttccatggtgtccttattgacccagccacataacagattgtcgtcattaaacaacaggtaacgggaggtcttgcgtggactgactaaaagggtggcattgatgttaggactatgctggtgataatacatcagactttcaaaatcgcaattggaaaggatatctacgttgtggagtaagtagcattctttccgcataactcctaaggttttttcgattatctcttcctcatccatccctttgttcagattttcgaatatcagttcatacggggtttcgcctttttgggtaaacatattctcaggatggtataataaatggtatgctttttccaaaccgccgccggtatcaagcaggcagtctgtttcgtccgagatttgtatgttgactccaaagttctggttagcttccagaaaagcaagaatctgattggaaaagtggtgtacattgatcactatttcatcaaatcctgctgctttcagctttaagatgatgtgctctaacatggtttttccacctaccgttactaaagctttgggacgggtgtctgttataggtttaagtcggctgcctagtccggcggcaaaaatcattgctttcataatgttctttcaaatgtttgttctatattctgctcacggtgtatgagttctacttttacaccgaattttttattgatatgttctgccatgtgttgcgctgaataaacagaacggtgttgtccgcctgtacagccgaaacatacagacagattgctgaaacctcgttccatgtatctttttactgaagcatccactaaagaataggcagcatttaaaaatgggaatatttccccgtcttcttccaaaaaacgaataacaggctcgtctaacccggtgaaaggtttgtaacgttcatattttccgggattgtttacggcacggcagtcgaaaacatacccgccaccgttgcctgtggggtcgttgggtattccttttttgtaggcaaaactcataaccttcacagtgagttgccgtttttttaagtcatctttaaattgtttcagttcggtcaggtcttttagtacggaacacaggtaggaatattcggggtattcattatgaagcaattgtcgcaggttctcgatggcgtatggtacactttggatgaaatgtggcttcttttcgaaatagccacggaaaccgtaggctcccaatacctgcaaggtgcggaagagtacgaagtgacgcaactggctaaagaaataatcacggtctactggtttgtatttggagagggcgtctatatattcttccaacagttcgttgcgcagggtttcgggaaatttagctttagcctgccataagaaagaggctacgtcatagaaaaacggtcctttacgtcctccctggaaatcaatgaaccagggtgctccatcctttatcatcacgtttctgctttggaaatcccgatacataaaagtggcggaagaactgcgtagcagtacatcactcattttttgaaagtcatcttccagcttgtcttcttgaaactccaggccggtagctttcaaaaagcagtatttaaaatagttcaagtcccaaaggatagaacgttggttgaattcggcttggggataacagtgtgaaaaatcaaagccgtctgctccggcaaattggatagaaggcagtaggcggatggtcttgcgcagcatttctttctcctcttcggagaagacgctggtcgcccgccctttttcaatagcgttgaacaacaggatatctcctaaatcttcttgcaaataacaattcttgtcttcagaacagatgtatacttctggaacaggaagacctttcttgcggaagtgtgctgccatataaagaaaggcttcgttttcttctttggaagtgccgtatacgccaatcagtttttgggttccggtcagccggaaataacgcctgttggaaccggatgagggtaattctacaatctcttcgggtacttctccgagataggtttgatataggttctgtaaatcctctgtaatcataatcatattttggaacaaagatatatattattctccctttcttggctgatttgcaaagaaagttaatgctttagttccaaattatgagaaaattacttgtttttactctttcatccgtatcagtgcatttgaaatgatggcagtcactccgcctgttgtaatgccggatgagaaaatattctttattgattccggaaattgacatagtatttcaggaaccatttctacacttaaacctaaagcgaaactaagtgcgatgactaatgttgctttccggttgatcttctgtgctgcgataatacgaatgcctgctgaagctactgttccgaacatcagtaaagtagcgcctcccaatacaggttcgggcattagggagaaaattaatcctacactgggaaataatcctaatagaataagaaaacctgcaatgtaatagcctacatatcggctggctactcctgtcagttgtatcataccgttattttgcgcgaaaacggagtttggaaaagagttgagaatacctgccagcatcgaattgaatccgtctgccaaaattcctcctgaagcacgtttgatgaatgtttttccttctacaggttctcctgatatcagtgaattggcagtaatgtctccataggcttctatggctgttatcaaaaatactaaccccaaagctatgaatgcggagaagtcgaaatccagtccgtatttgaatgggaggggaatattgaaaccaccaaaactttgtactgccgagaaatcaattctaccgagaccccaggcaactaaatatcctataatcaaaccgataacgatggaactcatgcgtaggtagcggttggaacttctattaaaaaggatgatgaggataagtactagcagagctagacctagattctcaaaacttccgaaagtgccgttgctttgggcggaaacacccccgccacaagctgtgatacctacttttatcaggctcattccaatcaaagtgactacaatgcccgataccagaggggtgattattttgcgggtatattttaagatgcggctgatgaccatctctacagatgatgccacgatgcaagtgccgaaaatcagtggaagtccgcccagcatacctgccgagatgatgggaccgataaatgaaaaactggttccttggatacataagagaccggtgccgatgcctcctatccgtctgcattggataaaggtagaaatacctgaggcaaagagagacatggatactaggaaactggtggtttccaaatccagttttaatgctccagcgatgataagaggcggagtgatgatggctacaaaaatagcaagtaaatgctgtatggcagcaaaaatggcctctcgtacaggggggcggtcgttcaatccgtaaatcagtccggtattggattgggcggtttgagattcctgcatggggttatcttattttgatttcacaattgtccagactttcaatgatggccaatgattctacgcggatacctgcattacgcaaataatctccgccatgttggaatgctttttcgatgatgaatcccattccggacagttcggctccggctttttctaccaaatcgatgatacccttggctgcattgccgttggcgagaaagtcgtcaataaaaagaacacggtctcctttggacaggaaatctttactgacacatacatcataagaacggtctttagtaaatgaatatacactggtggtgagcatattttccattgtgacgggtttctttttcttggcgaagacaacaggaagttccagtaagtagcctaccatgatggcgggagctataccactggcttcgatggtcataactttattgatattggtagaggcgaaacggcgtacaaattctacagcaatggatttcatgaggataggatccatttggtgattgatgaaattgtctactttcagtattcctccttcgaaacattttccgtcccgtaaaatgcgttcttttaatgctttcattcaaactgtattttataaatgagtcgcaaaagtacgtattttgctgcattatgccaaacgtttgtacaactatctctacagaagcctatttacttaatgatcaggaaagccggaataaataagcctgtggaagcataagctggtgtggattaaagaatgtttatttccacaaactttagtttatatatttggtatgtacttcttttcttgataatttagttctcaatataattttcttagtttagtattcttacttagcgaagatattctaatgggaggaaatgactgaatatgatgtatatttttcttgtcttttatgatatctgtcggtaggtaaacatttaaatttaaccattatgaaaaagatatttttatcacttgtattcctttttggtgtaggaacttttgtcatggctgatgataccatgaaagtaaagaatgatacagttgccgttgaagacggatttaaaaacatagacctgaaagaggttcctcaatctgttaaagatgccatagccaaaaaatatcccgaatcaactcttaaaagtgcttctctttctctgaaagaagaaggggtgaaggcatatagaataatatatgtaaccaaggaaggggttgaaaatagtattcttattaatataaagacggctcctgctaaaacggctcctgctacaaagtagtttgacaggtagtatagaattgaatgttttattaatatattgaaagccaccttgctatggtggctttttttgatgggataagtttttttcctgtcggatttagattttatatgtatcaaagaacaggttgaatttgtaagaaataggctatatgcttatatttgaacatagtttaaaatcaagtttataatcaaatagaaaaagtatgaaaagacaattatttacagtgttagtgtgcatgacggtgtttgctgttacatcttgtggcgaaaagaaaggaaaggataaattcgaggagcgtatagaaaaagccaaagaatcggttgaagatgtggtggatgatgccaaagatcaaattgaggataaagccgatgaggttggggaaaccttggataaagctaaaagcaagatagaaaaagccaaaaagaaacttgataaggctaatagagattgagaaaaattgattatggatgaatggaaagagattgtcggctgatttatattaaaccagccgacttaatttatatttctagacctttgttcaccatttgttataatggatattttcggtcttgaatttgtctttagcttcttcccgatgttgcggataacctaccggaatcaaattgaaaggaatgatatggtctggtaaagacaagactgacctaacctttgcaatgcggtcgttctccggatagaccgcagtccataccgctcccaaccccattgattctgctgccagcaacagattttcggatgcggcagagcagtccagcatccagtacctatctgtttctccgttcagggctttgcttaaatcaccacaaaccacgatggctagcggagcctgtgccgtcattttggcataaggcagttcggcggccagtttatccaatactttacggtcatccactaccacgaaagcccagggctgcttgtttactgctgtcggtgcagccatggcagcttttactaataaatccactttttctttttctatcggttggcgtgtataggtccggacgctctttcgggcaaagatattttctatagccgtgttctttcctgtttcttctttttttgcttccatattgttacaacctcctgtaattagtaatgttattgaaagagtaacagttgtcagagttttaaagattgttgccgcattcatttttattattgattaataattgagatggaattctaccacagcttcaattcctttgcggaatatatccagagagaagttttcattgggcgaatggatggcgtcactttccaatccgaatcccatgagaacggtctttatacctaggatttgttcaaaatcgctgatgataggaatacttcctccacggcgtacggcaagtggtttttttccgaatgccttagcaaagcctttttcggcagcctggtaagcgggcaaggtgatggggcatacatatccttcgcctccgtgcatcggggttacttttacttgtacatattccggagcgatagactggatatagtccacaaacaattgggaaattacagcgtggttttgatgtggaaccagtcggcacgataccttggcatatgcttttgagggaagtactgtttttgaaccttcgcctgtatatccgccccagatgccacaaatgtcaaaagagggacggcagctgttacgttctaaagtagaatatcctttttcacctttcagtgcttttacaccgatggcttccatgtattttttttcgtcgaaaggaatttgtgcaatcatctcacgttcggctgccggtacttcctctacatcgtcatagaaatgggggatagtgatgtgtccgtcttcgccaatgacttgggctaacatactgcacagggtattgataggattggctaccgctccgccgaagtgtccggaatgaaggtcacggttcggaccggtcacttctatttcccaataagccagtcctcgtaaacctgtggtcagagagggaagatccgcgcctagcatactggtatccgaaacaagaattacatcggctttcagcaattccttatgttccttgatgaaggtattcagactgggagaacctatttcttcttcaccttcgaaaataaatttcacattgtgtttcagcagtccgttttttactacgtattcgaatgcttttacttggatcatggcttgtcctttatcatcgtcagctccacgtgcccaaatgtgtccgtcacgaatttcaggttcaaaaggctggcttttccacaggtccaacggctcggcaggcattacgtcatagtgggcataaatcaatagggtaggagcatcattgcttacatgcttttgtgcaaataccaatggattgccttgtgagggcattaccatggcttcgtctgctccggctgccaacaaaagttctttccaacgtaaggcacaggccagcatatcgtctttatgttcgggtaaagcactgatactgggaatacggatgaggctgaaaagttcctccatgaagcgcgcttcattttctttaatgtattgttttatttccataattgaatgattcttatagttgtgtagttctgtctatcagataataatccaaaatggtcatggcagccatggcttctacaatggggacggcacgcggcagtacgcaggcatcatgacgccctttggctttcatggtcgtgtctgtgccgttgatatttactgtatgttgctccatcagaattgtggcaactggcttgaatgccacacggaagtaaatgtcttgcccgttgctgatgcctccttgtattcctccggaataattactttttgtttctactcttccgttattattataaaatacatcattctgctcactgccttttagctccatggagtcaaaaccttgtccgtaagagaaaccttttacggcattgatacttaacatggcatttcctagtgcggcatgtaacttaccgaatacgggttgccctagtccgatagggcatcctttgatgacgcaactcactaccccgcctattgtatcgccttctcctttgattttccagataagttctgccatttccttggctttctccggatcgggacaacgcacatcgtttgtttctatcaagtcgaggttatagcttttgtaatctttatcaagtttgacaggtcctacctgtgaggtataagctgtgacactgattcctagttgtttcaatgccaatttggctaaagctcctgctactacacgtgaaatggtttctcgtgctgatgaacgtcccccgccacggtagtcacggattccgtatttttgcatataagtataatctgcgtgtgaagggcggaacagattcttgatattctcgtagtcgtttgaatgttggttcttgttccataccacaaatccgatggggcagccggtggacttgccttcgaatatacctgaaaggaattccactgtatcaggctccttgcggctggtggtaagtaatgactgtccgggacggcggcggttcagttcctgctgaacgaaatccatatcaatcttaataccggcagggaagccgtcaatgacgccgcctactcccggtccatgggattcaccgaaactggttaaccggaaaatattaccaaatgaattgaacatattgcttgtagttttaaaagtttctttccgtaaagataatgattttagggataatatacttgattgttgctgaaaaattagcagaatggataaaaatggggtacggattgtatgaattttacagtttggaataagaaaaactgtaaaattcatacaatccgtacccggaaactgtttcttaaggatggaaacaggtatcttttacgagttagaattctaccttaggtgctttatcggctccttcctcagattcaaaatatgggcgtttgtcaaatccgaacatgccagcaagcaagttacgggggaaagtacggatggctgtgttatatgcccgtgctgtgtcattgaatcttttgcgttctacactgatccggttttctgtaccttccaattgtgcttgcaactctttgaagttctcattggctttcaagtcgggataagcttcggtgatagcgagcaggcggctcaatgcactacctacttcgccttgtgccttttgataggcctgcattttttcgggagtcaggtcatcggcgctgatctgcatctgagtggctttgctacgggcgtctactacggcttgaaaagtttctttttcgtgtgaggcgtatccctttactgtatttaccaggttgggtattaaatcagaacggcgttggtactggttttctacattgctccacgctgtgctgacagattcatccatttttaccataccattataagaggttattccccaaatggcaattaatacaatgactactattacaataatcgttgactttttcatatgtatatactattaaaattatgaatattcttgttcttaaaaacggcttccggctcctccgcctccaaagcttccacctccgaaacttcctccgctaaatccgcctccacttccaccgtggccaccaaaaaatcctcctcccattccgcctatgaacggccctcctcctcgggggcctttgtaattttcatctctcgaccgttctttccgtctgaggatatgtccgcaatttctgcatttatatactacttcttcagtctttgttccgttacttcggtctataactttggaagaaagacgttgcagtttgtgttttttgcaatgggggcagcgtgttttacgccagtttgcatacaatccgatgccaataaatcctccgaaaatcacaaaaaagatgataatgaattccaagggatcatcttcgctttcgtcattgccgatattttccatggaaccgtccaggtagccgtttacggcccgtattcctgctaccattccggcattccagttattgtccttgaaatagggcagcatatagcggttctgaatccgtttgcagatggcatccggcaatatcccttcaaggccatatccggtagcgaattgcacacaccgctcgtcggtggaaagcaagatgaccaatccattgtcacgttctttttgtcctacgcccgtttcctgtcccagccggtgggcaaaatcaaaacaatcacctccctctatgcctgttaccgctaccactaatgtttgtatacctgttttttgctctaaagcgtagaggatgctgtccatagtggtgacagcggtggatgaaaggataccgtcgggattgctgacgtagcgggtacggttttgcaaatgtaccatcggtatgtcttttatggcatattctttggcttgaagctggacggagcctagaagcatgaaaaaagtaagtaaaaatgtcaaatttctcattggatgtatttgtctacaaatgcttttactttttgggtatattcttcagtattgaacagataggaatgtgcatggtctgcttccggaactatccataatgctttgggctgaggttttgcctcatacaatttgtacaccatccatgtgggtacgtagtcatctttatcaccatggataaagaacatgggcagatggcatcgggctacctgtttcaatgcggatgcttctttgaacccccatccatattccagctggcataaccagtcggcggtgtacattaacgggaattgaggcaagccgaattgtgctttcagttctttggaaaattggtcccatacgctggtatatccgcagtcctcgacaaaacatttcacatagtcgggttgcggttcgcccgaaaccatcatagtggtggctgcacccatcgagattccatgtactaccatgctggtgctgtcaccgtaaattcgattggcaacctccatccattgtgttacatctttgcggtctaaccatcccatttgtatggcatttccaccgctcaggccagtgtcgcgtaaatctggtaggaggatgttgaaatccagttttttattgtatagataacctatcatcatcatgcggatggcattgtctgtatacccgtgtactataactgcggttttggctgtcgggcggctggaagccacatagtaagcatgcagttttacgtggtcgggagaatagataaaggtatccttcagtgcttggttctgtttcagactatctatccacggttttagataggggtaagtcttaaacatatattgccaggaactttccaaattctttcctctgttttcagggcgtaaggaatagttcagcatatattgactgcctccaagtaggactataataagcagaacgaatatactactcgttccaataatcattttttttcttttcataccttaactatttgttccatatatcccatgcaccaaaggcttgcaataagagcatttctaaaccgtttttggtaattgcccctttgtctgccccctttttcataaaaagagtagtgtcaggattatataacaaatcataaagcaaatggttgggtgtgagatattggtatggaatattgggatattcatcggcacggggatacatacctacaggagtacagttgacaactactttatactcatccatgatttcgggagtgagctgatcgtaagtcagcatttcttcacgcaggttccgtgatacgaatttgcattccaaacctaattttttcagtccgtaagcaatcgctttcgaggcccctcctgttcctaggatcagagcttttttgtgctggggttccagcaagggttcgatagattgagtgaagccaatcacatcggaattatagcctatcagcctggtcttacctttttggcggacaattttgattacattgacggctccgatggctgccgcatctttatccagttcgtccaaataagagatgacttgttctttataaggtatagtgacattgagccctactaaatcaggattagccaatagcacagaaggcagttctttgatggatgggatttcgaagtttacatattcggcatcaatgttttccgaatgaaacttttcattgaaaaagttctttgagaacgagtgtcctaacggataacctatcaaaccatattttttcataaaactctatactttaaattatttcgttgctaaataaagcgtacagatacctagtgtcaaccgcttgaaactcacctgattgaatccggctttacggataatgtctgtcattatttcgccttgtggaaaggctttgatggactgcggcaggtaagtgtaggcactacggtctttagagagtagcttgcccaaagtggggatgactattttagaatagacagcatatagctgtttcatggggaaccagtcgggttcggagagttccaaaatgactagttttccgttgtctttcagtacgcggtgcatttcgcggagtcctttgtcaaggtcttcgaaattgcgtacaccgaatgctacggtaatagcgtcaaagcgtttgtcgggaaaggtgagtgctgtacagtcttccttagcgaaagagatgcggctgtccagtccggcggcttttactttttcacgtcccacattcatcatgccttcggatatatcggtacctatcagctcttgggggtgaagtgtctgacaggcttgaatggcaaaatcgcccgttccggtggctacatccattatatgttgcgggtgaaaaggttccagccagttaatggctttgcggcgccagcttttgtcaatgttccatgaaagggcatgattcaactggtcgtaagcaggggcaatgttgtcgaacattttctctacttggacgcttttcttttcgtcagcgttgtagggcttgattttttcttgtgggtagttcatgtttaattaaaattgaaaattaaagattaaaaggagaggatggaggatagattcctgtacctgtcttttaatctttaatttttcatttttatttatttcaagtattcggttacgttcttttctatacgtgcggcgatattttcagtgtctgctttcacaaatttttcgccggtgatgtgttcgaacagttccatatagcgctcgctgatagaatttacgatttccggagtcatttcgggaacttgttgtccttctttgccttggaaaccattttccatcaaccattcgcgtacgaattctttagaaagttgtttttgaggttcgccttttgcaaagcgttcttcataaccttccaagtagaaataacggcttgaatccggagtgtggatctcatccatcagataaatagtgccgttgtgtttaccgaattcgtatttggtatctaccaggatcagtccgcgttctgcagcgatttcagtaccgcgtttgaacagagccaatgtatacttttccaatatttcgtattcttcgggagtggccagaccttgtttcagaatttcttccttagagatgtcttcgtcatgcaggcccatttcggctttagtggttggagtaatgattggttcgggaaatttctggttttctttcattccttcgggaagttttacaccacagatttcacgaacgccgtttttgtaagcacgccatgcgctaccgcacaggtaaccacggacaatcatttccacaggaaaaccttgacacataactcctacggtaaccataggatctggagtcgccattttccagttggggcagatgtcggtagttgcatccagaaatttggctgcaatctggttcagcatttgtcctttgtagggaataccttcaggcagaactacgtcgaatgcggagatacggtcggtagctaccattactaacttttcgtcattgatgttgtatacatcacgcactttgccgtggtacacacttttctgtcccggaaagttaaagtctgttcttgttaatgctttactcatgtctttatttataattaaaatcaataaattcgttttatgttttcagatttttcacttcgttcagaatgacatgaatgaaaggttttctgtttttcttcaaacttctcgtatgcttccacaatgcgggtaaccagtttgtgccgtacaatgtccttcttgttgagttcgatgaaactgattcctttcacgcctttcagaatttttagtgcctgtatcaaccccgaagtttgtgaagatggtaagtctatctgtgtcatgtcacctgttacaatcattttggtgttcatccccatacgggtgaggaacatcttaatttgctgggtggtggtattttgagcctcgtccaatatcactacagcatcattcaaggtgcgtccgcgcataaatgccaatggggctatttgaatcacattcaattccatatattcttttagcttggcggcgggaatcatatcttgtaatgcgtcatacagtggttgtagataagggtcaatcttatctttcatatcaccgggtaaaaatccgagtttttctcctgcctccacagccggacggctcaaaataatttttttgatttctttgtttttcagggaacggacagcaagggcgatagcagtgtatgtctttcctgaacctgcgggaccgatagcgaacagcatatcgttcttttcatattcttgtaccagcttcaactggttctcactacggggaacgatcggttttcctgttacactgaatacaatagtatcccctgtattctctatttggggtgaacgacctttcactatgtctaaaatcacttcttctttcagtgagttatactgggcgcaatgcttttccaatgccaatatattctcttcaaaagcacacatttcctcttcgtctcccaatactttgatgacatttccacgtgccacaatttttaatttgggatacaaagcttgtatcattttcatattgacgttgtttacgccataaaatatcacaggatcaatatcctctaaaactatatgtttttctatcatttaactagtttaggtactttatgtacttgtttatagggtgcaaatttaatgaaaggttttcattgttcttattttccgggcaatttatttgcataagctttttcagaaaaaggattttaatctatctttgcgaggaatttgaaaagatagttagattatgaattgtatgaaaggtgcatgttgcacgctattgtcacttttgttttccttgacagtttcttccggttgcaaggaaaaagatatgtccatgaagatgaacgagcctcataatataaaaggtgtaattagctataaacgtagtttcggtgatttgaatgatactcatctcagtgtggcgaagaaaataggaattcgtccgttggcttctcgttcggaagcagaggggttgggtggcaaattggttcagataaaaccttgtgagcgttatgccatggattcgctgactcactccattccttttctgattccgcaggctagtgcgttattggatacaataggagccaattttttggattcattgagttgcaaaggattgaatcctaatcaaatcattgttacttctgtacttcgtacggcagatgatgtgaaacgtcttcgtcgtcgcaatggaaatgcttctgccaattcagctcatgcttttgggacaactttcgatgtcagttaccgtcggttttgtaaagtggaagacccggatggacgtcctatgcaggatgttagtccggatacgctgaagttggtattggccgaggtactccgtgatcttcggaagtcggataaatgctatattaaatatgagttgaaacagggatgttttcatataacagcccgctgatttattgaattttcacttggtcggaggctttacgatgcggtatttcatatatttggcttatgatggaacgaattatcacggttggcagattcagcccaatggtgacagtgtacaggaaacattaatgcgtgctctttctacttttctccgtcaagaaatagaggtagtgggagcgggacgtactgatgccggtgtgcatgcgcgtctcatgatcgcgcattttgattatgaccgggagttggattgtgttcagataacggagaaattgaatcgcttgcttcctcccgatatagcggtttacgctgtaaagcgggtgaaggatgatgcgcatgcccgttttgacgcgacttatcgtacttataagtattatgtgactacccggaaagatccgtttaaccgtcactatgcctggaggctttttaattcattggattttgagaaaatgaatgaggctgcccgtgtattgtttgattatactgattttaccagtttcagtaaattgcatactgatgtgaagacgaataattgccggattatgcatgctgaatggacgcaggtgagcgggacagaatgggtatttactattaaagctgaccgttttttacggaatatggtaagggctgtggtaggtacgttggtagaagtgggacgtggtaaaatgactgtggatgagttcaggaaagtgatagaggataaagatcgttgtagtgccgggagttctgttccgggacatgccttgtttttggtagatgtgggatatccggaagaactgtttattgtttctccgtcagatatttccaatatctgacaggcatatcttgccggtgttttctgggattccaacgttctttgatgcaaatggacttgaaatatgttttccaaagtttctgaaacaatttctcatcattgtccatcaatgtttcatttagcattcctgtgaccagatgcgcttggcgggggtcttcaaatgttacttcttccatctccgtcagattatagtaatatccatattgtcgcttcacatcataaatgagccaacgctggtcggcaaaccggtctttgaaatgatccacagccagtggcagtgcgttgaattgaggctctacggctgcaaagaaagttccgtccgcagctttttggaaacggacgaactgcatgaggtgtactcgttctccatctactcttttatagattttcgcaagctccagcacatcaggatcggcaaagttggtttcgatggaatgaggagagtttatggccttccggatatagcggaaaagcatttcgtccacctttggtaattctgataaccagcagcaggtcaggcagaacagggcatgcttggagatttttttctgtaatccgcgccacactcgtccggctttctcttcatcagtggctatgtgtatggcttcatcataaaataagggtagcggctcgccttccatcaagagcgagtctggaaaggttttgcggaagtaggcatcgaaaatgcaagtcagcaagccttcaaatgtatggtcatagataaacagaatcattcgttatcagtgaagttcagtattaattggcgttcgtccactttctttttgggtttgggtactaacagtctgcgtactcctgtcggggtcagttcattaacagttcgggtggggagttcgttgcatgttatgaagtattgcgcttttttcatcactacacctatttttttcagttcatagaatcccagtttggagaagcggcgtgatgcgatgatttgtcttgccgatttgattccgatgcccggtactctgagaatcatttcgtaatctgcctgatttatatctatcggaaatagttcgggatgccgtaatgcccaacctagtttgggatcgatttccaaatccaggtcgggataggagtcatctactatttcttctactttaaattgatagaaacgtaacagccagtcggcctgatacaaacggttctcccgtaccaatggcggctgtttcagtgccggaagtcgtttgtcgtatgtatttacggatatatatcctgagtagtaaacgcgcctcatggtggggtgttggtagagtgaagaagaaagataaaggatgtctttgtctgattcggttgtggcaccgacaatcatctgcgtgctttgtccggcaggaacgaagcgtggaacatggcggaattttttccggtcttccttattggtaagtactccctgctggatatagcgcatgggctggtacacacttttgtgatctttttcgggagccagtaatttcagattctcttctttgggaatttctatgtttacactgaggcggtcagcgtagagtccggcttcattaactagttcgcgactggctccggggatgcttttcaggtgaatatatccgttgaatttgtgtactaaccgcaggtctttggcaacacgtaccaacctttccatggtgtaatccggattgcgtacaacgccggagctgaggaaaagcccttctatatagttgcgccggtagaattcgatggtgaggtctaccagttcgcttaccgaaagtgtggcacggggaatgtcattacttcttctattgatacaataggcacagtcatatatgcaataattggtcagcataattttcagcaaggatatgcaacgaccgtcctcggcgaagctgtggcatattccccagccgcctacggtgtttcccaatgtgcctgattggttacggcgcacagtcccactactggagcaggaaacatcatatttggcagattctgctagtactttcaatttggcaaggacattctcattcatttaatcagaatatttctgccaaaaatacagatagtctttggaatgggcaaacggtttggcattttctccgttaatttttaacttctttgttggattatgctgttccttttttctaattacaatataagcccgcttgctttaagcaggtgtgtattggtggtgactataattcttttaacttctttgtggagaatatatggggtattggaacggggatgaactctgtatgaattccatcgctttttttatgttaagatgctacttaaacattagtttatgtaatataaattaaggcggtttgcaaattatttattaatttcgcacttcatttttaatgtttaatataaaaaatatttatggagtggtttaagaaaaaaatgagagtctttctttttgtctgtttgttattccctttttatagttatgcggcaaagatttctttgtctataagtggtaaaatagaagatcattcagcaatgctttattttcctgacgggagagaacttcctatttcaatagatgcttcaggaaagggagaattggtagtcgatgttacggagcctgtttatgtggcattaggttatcattatataagtcgtactttgttgcttacacctgatacagatatacaaatttcttttgaaaataaaaaatttggagaacgtgtagccattacaggcacaggttcacaagtaaatatctatttgaataacggacgtttgaaagcagcaaaaattgatgatatggcattaggagaaaaagcgttctttttgaaaatggatagtattttgaatgtaaatctgcaagagttggatcatgccggattatcagaggaaattaatgaaatggagaaaatacgtttgaaatattttacttgtgctacattgccttcttatccttatttccatatgcgtatagctaaggattctacttatgaagcttctttagaatattggagtaagttacaggagttgatggttatggatgcttctttgttgcgatatgacgaattccgttcatttttggttgaggcggtaagcagagtggcaagaaaacaatacccggaatcaaagtctttggatgcggtagtccgatatgtggaatcggaagtgaaggagcctggtattgcagagttcttaataaataagaatgtatatgcttatgtagagagatatggacttgattctgctgatgcttattgtgctgtgttcgatcggtatgtaaaatcaccgctattggtgaagaattttgagacattgtgcaatcgttggcgcaaattgtcggtaggagctctttctccaaattttaactgtacggatttgtctggtaaaaaagtttctctttctgattttaagggaaagtatgtatatatagatatttgggctacttggtgtggtccttgccaacgtgaaattccacatttgcaaaagttagaagaaaaataccatggaaaagatatttattttgttagtatctcatgtgataataacaaaaaagcatgggaaaatagagtgagggctggtttaaagggtattcagttgcattttgtaaatggagatacatttatgaatgactacatgataaaggggattccccgttttattcttttagataaggaaggaaaaattatatcggtggatatgagtcgtccttctgatcccaaaacaatagctaaattagatgaattacttaactgacttttatattgataaatttttttaattttatgagtgaagaatcagtaaactcaagaaggtgcaaagggggaaatctgtttttttcaagaattcttttttgtatttgtttgtgtggaccggtagcttatgcgttggcagaggaaagtactgtcgtttcagaaatacggcagaatgaaaaaaaatctatttcgggagtggttacagatactaatgatgaaccgttgattggagcgactgtattggtaaaaggaactcagaatggtaccgtaacagatgtggatggacgtttccatctgaaggtaaacagtggggaaacacttgtggtttcatatattggtatgaaatcaaaagaagtggcggttgtggatggaaagaaagagctttttattcggttggatgcggacactgaaatgttggatgaagtgttggttactggatatcagactttgtcgaaagaacgttctacgggtgcgttttctaaagtttctactgaaaagttagagttgaaacgtatggataacttgtcttctatgcttgagggacaagtggctggatatgtgaatggacagattcgtggtgtcacaaccatgaatgctgtcgcgaatccgatggtcgtgattgatggatttcctgtagaaaatacaacattagacagaatagggcagacaactgaaaatatgcctgatttaaatccggaagatattgaaagcgtaacagtgctgaaagatgctgctgctgcttctatctacggtgcgcgagctgctaatggcgtgattgtgattactacgaaaaaggctaaagaaggtaaagcggaagtaagtttttcttctacctttacagtgcacccttattcttattataaaaaaaatcggactaatgcggctgatgttattgctatggaacgtgaatgggcgactatggcattgagtacgcctgaggctgcggagatgcaggctgccgatttgcgtgaaaacggaccatatcctagtttgggagttaatactttgttagatatgtacactgggaaaatcagtatggctgagggagataaaattctgaatcagttggcttcctacggttatcaatattatgatcaggcagaaaaatatggtaagcgtaaccctttttaccagcagtataatttgagggtaggtaaaacaacagagcgtaattcttttaatttctctactacttattgggataatgattatgaggatataaatcatagtgattggaaattaggtatcaatattactaattcattacagctaaccaattggttgcattttgatacaggcgtttatctgaaatatggcaaagagaagaaccagtcatatgatttgtttgatccgggcttttctgtcatgccttatgatccgttggtcaatgcagatggaagttattttgtggcaccttcacaaagtgacaagtcacgtcgtgatttagtggatcaatatgggctgtattcagaagatctcgtgccgatggatgagttgaattatgctcttaatacaaccaaaacttttgaaacccgcgcttatgctaagttgaagtttgatttgacttcttggttgaattacaatgtgatgttccaatatgaaacaagtgattcggattatgaatcattgggtgagaaagagtcaaattttatgcgtaagcgtattaatgattttaccagcaaatcaccgaatggcagttctttggtatataatctgccgaatggagattcgtttcatacgttgaagaacagcaaacatagttataacttccgtcaacagttgagtcttgataaaacatttgatgaaaagcataatttagtatggatattaggacaggaagtgcgccattcattgattaattttgatgaaaatacggtatacggatatgatccggagcttaaaacatggcaaaattataatatgaaagatttggcttatttttcgggcttgttaggatctgctcagttagatcagaatagtattgcttcgtctcgtgaattgcttaatcgttttgtttccttctattcgaatgcatcgtatacgtatgatgataaatatgtactttctggaagtattcgttgggatcgttcgaacttgtggggaactaattcgaaataccagaataaacctttatggtcagtcgggggaagttggaatatctataaagagaaattctttcaagcggattttgtagacatgttgaaattacgcgcttcatacggtattggtggtaatattgggcgtaatacagctccctatctgatagcttcctattatgattccagccttgtggatggtatggcagggtctgtgaatactcctcccaataaggatatccgttgggaaaagacaacgactgtgaatgtaggtgtagattttgctttgttccgtcatcgtctgtcgggaacaatagagtattataataaatatagtgttgatctacttgctgctataaatggtagtcctacacaagggtttggctatacaacgttgatgacgaataatggaaaaatggtaaaccggggagtggaaatcactttgagcggagagattatccgtcagaaggactttagttggaacgcttcattgttatatgcatttaatcgtaataaagtaaaacacatcagtgtgcaaccaagtttgtgggatagccgtataagtatgcctaccagttatcctatggttggaaaaccattatatggtatttatgcgtataagtgggctggattgaatgagaatggtgatccacaggtatatgatgcggaaaataatgtcacttcaggtcctgcacgtgattatcatgcattggtttattgtggtacgactgttcctatacataatgcttcgttaaccaatgtattacgttataaaggttttgaattttcagcaatgctgatattggatgcaggtcacaagttgcggtcaagcaatattccaagcattaatatgtcgaacggacgtattacatctactgctaagggtatagtggaccgttggactcagcctggggatgtaacggacgtaccacgtctgcttttctctaatgatacggagaattttaatacacaccgtacggaattatatcgttattcggatttgtttgtgtatgatgcatcaaatattcgtttgagtaatatttcattggcgtacagagttccggcccattggtgcaagaaaatttctctttccggcgctcgtcttcagttcaatgtagagaatgtagcaacatttgcttttgatagtaaagcgaattacgatttaggcggtaaagtgaaaccgaattatgtatggggattgtatttgaatttttaaaggatgaataatatgaaaaaacaaatgataaagataagcagtctgctttttgttatggtggctatgatgctttccgcttgtgatgattatttggatgatgtgccgaaagggcagaagattccgaagacatgggaagactataatgcttttatccgaaataatttttcctaccattttcttgatcccgatcagcttgcggtattagcaggagatatatttaaacttccttctgccgtaactagtccgtcgttaacacgtgccaattattacgcagatgaatctgtaaatcgaatagacttaatgacaggcaatgataagaacccttattttaatgcttatgagggactttttgcgtggaatctaatcgtagaggatgtaccggatgcgacagaatgtacggaggttcagcgccgtcagttaatagctcagggacgtgttcttagagccatgcattatttttatttggctaatttttatgctgaccagtatgatgaggctactaaggataaactgtcagttcctttgataacttcggcttctgtggaggctccgtcgccgcaggtaactttgcaaacaatctatgagtttatgcttgatgatttgaataaggcggttgaagatctgcctgtacatagtgagtcgattcttcatcctaatcgggcacttggatatggtatgttggctcgagtgtatttgtctatgggggattatgacaatgctttgaagaacgcttcattggcattggagcaaaatgaccagctttttaactggatagatctttatgaggcggataaggagcgctatgatgatcccaagaattatacatcaggggtagccggtaatcctgaaacagataatgtagagaattatatttattgttatggatcttccacttcaggctggactggcttgaataacacaagctacgctatttctcctgaacgggcggctcgttttgaaaagggggatactcgtctgctgacccattggaaatccagagtgtcatcttccggtattccttattatgcgggtatctatgctttggaaatgaataaaggaggtatgcgttcacctgaaatgtattatataaaggccgaatgtttggctcgtaaagggggagaagctaatattagagaagcaatggaactggtgaataaggtgagaaaaacacgtattcttcttgagttttatcaagattggactgctgcaacaacgaaagaagcagtggaaaaaataataagagataaagagagtgaatatatccagactcaggttatatattgtgattatagacgtttgaataaggatccggagtatgcccgtacttttccacgcactattgaaggaaaagagtatattctaaagtctgattcgcatttatggattatgccttttccgcgtgaagccgtatctaatcctggaaatggaacgattacacagaatgtggaaaagtaataaagcgataattttgcgatagaatttatattatcgataggagtattctgaaaagattaagaaatatccggatatcctatagagagaaacaaaaagggcggaacaaaaaatccgcccttttctcgttttattatttttcaaattggattagtggcaatgtccgcatccacagttgttttcatcactacaaccatcaccgcatccacctccgcagtcaccacaaccacagccgcatccttctccactcatcatttttaccatttcctgaatttcttcattagtggctgtgcgggattctactacttcaccttcaaaagtgagatctttacctgcatgaggatggtttaaatctacagtaacagtgtcattggttacttcgcttacggtagcgtagaagtgatggccttcattgtcctgtaagggaatgacagcccccgggaagatacgttcttcatcaaaaacaccatcaatggtgaacatatctttagatacagtgcgcacaccttcgggcatatattctccgtaggcttctgcggtaggaatgacaaattcaaatttatcacccttcttcaaggctgttatttctgtttcaaagcgttccagtgtggttcctaagccggatatgaactggaaagggtgttctacagttgcttcttctaccaatgttttctggccgtcttgcattacataaagtttgtatgctacggtgatgtacttattttccatgttttcttattataataatgtaatataaactacttacgtaagttttccgttggcaaagatacgaattaattccccttaatcctttgttattacgtttatattacataaatttgttattatgatactataaatgcattttcggtggcgtttaatccttgatataaatcaattaactgctcgttttgatagatgtttgctttaattaacagatatatgacaacatgttataaagcatgttgttatatttgcaacgtaaagagaaagagataacgagattgtttttaaaaggtattatttagttcttaggtactaagtaaattgtttttaggtttaacaaattaaaattttaggtattatgaaacgtttagtattgttggttgtagtggcattaggaatgtcagctacaagttttgcaggagaaaaagtagaaggtaaagattggaaggtagatgttaacgtcgcaaagttgagcaaatatttgaatctggatgcacgtcagatggaggaggttgctaatatttctgattattttgctgacaaagtgcaaagcgcaagctacgcaaaagaagctaaacaaggtaaaaaattgcgtgaagccgtatatggaaacttcaaactgatgaaacgtacattgacaaatgagcagtacaagaagtatgtgcagttgttgaatgtcacattgaaaaacaaagggttggattcctatatggaagatgcggcgaataaataaatttataaagtgaaataaatgaatagaaaagagagtgcattggtttgtattctcttttttatttatccgtcggaagatatagtgtatatttgtgataaaatgattgtttaaagcccgatttagttacgaatgataatttataagaaaaaaaatcttcattttatttgtttgttacaaaaaacgctttacctttgcagtcgttaaagaaacaaagaaaacagatatatgaatattactactctaaataacctggcagtcctgcatattattcgcgtcgtggtggtcacactgggagcgtgagaaaggttgtgtatgtgtagttgtacatataaagaaataattgaaagcctttctcacatggtgaggaaggctttttcaataagtataggacgttatagatttagaataagatgaagaatcagttacgcagttcgtttagcacacagggtcgccgtatggcaggagcgagagctttatgggtagctaacggcatgaaaaaagaaatgatgggcaagcccattatagccatagtaaattcgtttacacagtttgttccgggacatacccatctgcatgaaataggtcagcaagtaaaagccgagatcgaaaaactgggatgttttgcagcagagttcaatacaattgccattgatgacggaatagctatgggacacgatggtatgctatattcactgcccagtcgtgatatcattgccgacagcgtggaatatatggtgaatgctcataaggcggatgcaatggtgtgtatcagtaattgtgacaaaatcactccgggtatgctgatggctgccatgcggctgaacataccgactgtttttgtatcgggtggtcctatggaggcaggagaatggaataaccagcatcttgatttgatagacgccatgattaaatctgctgatgcatcggtcagcgatgaggatgtggctcaaatagaagataatgcgtgtcccggctgtggatgctgttcaggtatgtttacggctaattccatgaattgtcttaatgaggctattggtctgggacttccgggtaatggcactattttggcaactcatgccaatcgtactcagttgtttaaagatgcggctgctctgatagtgaagaatgcttataaatactatgaggaaggagatgacagcgtgttgccacgcagcattgctactcgtgatgcttttctgaatgccatgacattggatattgcaatgggtggttccaccaatactgtgctccatcttttagctatcgcccacgaggcggaagtagatttcaagatggatgatattgatatgctttcacgccatgtgccttgtttgtgtaaagtagctccgaacacacagaaatatcatatccaggatgtgaaccgtgccggcggtatccttaatatattgggagaattatccaagggtggtttgctgaaaaccgatgtgaaacgagtggacggtctgacattggcggaagctgtcgaaaaatataatatatgtaagaaggaagtggatactgaagcaaaacgtatctattcaagtgctccgggaaacaaattcaatataaagctgggttctcagaatgctgtttataaagaactggatacagatcgtgccaatggttgtatccgtgatttgcaacatgcttatagtaaggacggaggtttggctgttttgaaagggaacattgcacaggatggttgcgtagtgaaaacagccggagtggatgaaagtatttggaaattctcgggacctgccaaggtgttcgattcgcaggatgctgcttgtgaaggtattctaggaggaaaggtagtcagcggagatgttgttgttatcactcatgaaggtccgaaaggtggtcccggtatgcaggaaatgctttatcctacttcttatatcaaatccaagcatttaggaaaagaatgtgctctgattaccgacggacgttttagtggaggaacctcgggattaagcatcgggcatatttctcccgaagctgcagcgggtggtaatatcggaaaaatagtggatggtgatataattgaaatcgatattccgaaccgcagtatcaatgtgaaactgagcgacgaagaattggccgcccgaccgatggcaccggtgacccgcgaccgtaaagttcctaaaagcttgaaggcatacgctagtatggtaagttctgcagataaaggaggagtgagaatcattgactaaattagaaattaaaaattgagaataaaaaacagtttcgttgtcatcggccagttgtccggcatcgtatttttttgaatctcaattctcaactaaacaattatggcaaaagaaaagataacaggagcagaggcgatgatgcgttctttggagtatcaaggagtaaaaactcttttcggatatcccggaggttctatcatgcctacttttgatgctttatatcatcataaagatacattgaaccatatattggtccgtcatgaacagggagctgcccatgcagcacagggatttgcccgcgtatccggggaggttggtgtctgtttggtgactagcggacccggtgcgacaaataccatcaccggcattgccgatgctatgattgacagcacgcctattgtggtgattgccggacaggtaggagcttcttttttgggtacggatgcttttcaggaagtagatctggtgggcatcactcagcctattaccaaatggagttaccaaattcgccgtgcggaagatgtagcttgggctgtagcccgtgctttctatatagccaaaagcggacgtcccggtcctgttgttctggactttgccaagaatgcacaagtggagatggtggattatgaaccgatgaagcttgattttatccgtagttatgatccggaacctaatcctgataaggaatctcttcaggaggctgccgaattgataaacaatgcccaaaggccattagtgttggtagggcagggggtagagttgggtaacgcgcaagatgagttacgtgcattcatagaaaaagccgatatgccttgtggctgtactttgctgggactttcggctataccgacttcgcatcctttaaataaaggaatgttaggtatgcatggaaatctggggcccaatgtcaagactaatgaatgtgatgtgttgattgccgtaggtatgcgctttgacgaccgtgtaaccggaaaattagatacatatgctaaacaggcaaaggtgattcatttggatattgaccattctgaaatagacaagaatgtaaaagtggatgtacccgtattaggtaattgtaaacatacgctagctatgctgacgcaacttatccgggagaataaacattccgaatggattgatagctttgctgaatatgaaaagacggaatatgaacatgttatcagtaaagaaattcatcctgttgacggggcgttgaatatgggtgaagtggtgcgtgcggtgagtgaggcttcgaataatgaggccgtactggtgacagatgtgggacagaaccaaatgatggctgctcgttattttaaatacagtaagaaccgcagcattgtaacttcgggtggattgggaacaatgggattcggtcttcccgctgctataggcgctactttcggttgcccggatcgtactgtatgcgtatttatgggtgatggcggtttgcagatgaatattcaagaattgggaactatcatggagcaaaaagcgccggtaaagattattttgttgaacaataactatttgggtaatgttcgtcagtggcaagctatgtttttcggtcatcgttattcatttactccgatgttgaatccggattacatgaagattgccgaggcatacgagattcctgcccgtcgtgtcatgaagcgcgaggaattgcaggatgctatccatgagatgctggctaatgacgggccgttcctgttggaggcttgtgtgatagaagagggaaatgtattgccgatgacacctccgggaagctcggtgaatcagatgttactggaatgctaatttaataattatggataagacattatatacattaatcgttcattcagaaaatatcgccggtttgctgaaccagattacggctgtgtttactcgtcgccaaatcaatatcgaaagtcttaatgtttctgcgtcttccatcaagggagtgcataaatatactattactgtctggactactcaggatgtgatagaaaaggtggtgaagcagattgagaagaaaatagatgttttgcaggcacattattttactgatagtgagatttatcagcatgagattgctttgtacaaggtttctactcctgaatttcaggagaatcctatggcatctaaagttatccgccgttatagtgcccgcattgtagaagtaaatccggttttctctattgttgaaaagaatggaatgagtgaggaaattactgctctttatgaggagttgcgcggattgggatgtgtgttgcagtttgtacgttcgggacgtgtggcgattactaccagctgtttcgagcgtgtgaacgaatatctgacccaacgcgaggaaaagtatcgccagcaaaaaacggaataatgatgagtgagaataaagtaggaacatacagatttgtggcagaaccctttcactgtgatttcagtggaaagttgactatgagtgtgctgggtaaccatttgctgaattgtgccggctttcatgctgccgaccggggatttggaattgctacactcaatgagaatcattatacatgggtactttcccgtttagctgtagagttagagaatatgccttgtcaatatgagggattcagtattcagacatgggtggagaacgtgtatcgcctttttacagaccgtaattttgcaattttggataaggaaggaaaagctgtcggatacgcccgttccgtatgggcgatgatcagtatggaaactcgcaaacctgctgacttgcttacgcttcacggaggtagtatcactgattatgtatgcgataaggaatgtcctataagcaagcccggtcgtattaaggtgacagagaaaactccggtttctgaataccagaccagatatagcgatattgatatcaatggtcatgtgaacagtattaagtatatagaacatattctcgacctgtttcctatagaattttttaaggagaaacggattaaacgttttgagatggcttatgtagctgaaagttattatggtgatatattgagtttctaccgcgaggaagtgggggagaaagaatatgatatagaggtgaagaagaatggcacagatgttgtcgttcgcagtaaggtgatatttatttagaatctaatttttaatttttaatttataatttaaaatggcacaattgaattttggcggcgttacagaaactgtagttatccgcgatgaatttcctttggaaaaagcacgtgaagtattgaaagatgaaacaatcgctgtgatcgggtatggtgtgcagggaccggggcagtctttgaatctccgggacaatggtttcaatgtaatcgttggtcagcgtccgggaaaaacatatgaaaaagcagttgctgacggatgggttccgggtgaaactctgtttggtattgaagaggcttgtcagaaagcgactatcgtaatgtgtctgttatctgatgcagctgttatgtctgtatggccgactatcaaaccttgcttgactcaaggcaaggcactttatttctctcatggctttgctattacttggagtgaccgtacaggggtagttcctcctgctgatattgatgtgatcatggtagctcctaaagggtcgggtacttcactgcgtaccatgttcttggaaggtcgtggtttgaactcttcatacgctatctatcaggatgtaaccggcaaggcttatgaacgtactattgcattgggtattggtatcggttcaggctatttgttcgaaactactttccagcgtgaagcaacttctgacttgactggtgaacgcggttctttaatgggggctatccaaggattgttgttggctcagtatgaagtattgcgtgaaaacggacatagcccttctgaagcgtttaatgaaactgtagaagaattaacccagtcattgatgcctttgtttgctaagaatggtatggactggatgtatgctaactgctctactactgctcagcgcggtgcattggattggatgactccgtttcatgatgctatcaaacctgtagttgaaaagttatatcacagtgtgaagactggcaacgaggctcagatttctatcgattctaactctaaacccgattatcgtgaaaaattggaagaagaattgaaagcattgcgtgaaagcgaaatgtggcagacggctgtaaccgtacgtaaacttcgtcctgaaaataattaatagttagtatttagtatagaaagcgggggtgcgatgaggcatctccgctttcttttatatatattaatgttagtggtattgtttatatcatgtgtagtcgctaattttgtgaaaacttgacttagacatgaataatagattatcacttttattaatagggtgcatatttccctttctatctttttatgcacaaaagaatatgaatcttccaccatattatcccacagtaaaaggtattacggattatgctgtgtggcagcttgtatatccggattctttattaaaggcggatattgcaggtgaagcagtgtgtacactccgcattgatagtttgggtattgtccgtagtaaatatattgaagccactcatcctttgtttgccaaggcggccgaagatgtgattgaggggatgcgtgaatggcagcctgcaaagaaagcgggtagagatatagatagtactgtagtctttcatattccttttaatcctgatatttacagtgaccgtatttggcggcagcagcaagttctggaatcttgcaggggacaatttgtcgattccatgcctgtctttccagatgatattcgtagtcttgttatgggaaatatgggttggcctgatgataaagtggataaagccgttgctatttgccgttttacggtgaatgaaaacggggagattatgaatatccgtgtgataaaaggcactcatccggcttttgataaagaggctatacgtattctttctaattttccccggctgattcctgccatgaaaaacagcaaacctgtgccatatgattattttttgactatgcgtttttggaaagaggatctggaacattatttattgtatagggaatgtgcacaggaagatttggaaaagaccacttgggagccttatagatactcttcttatcccggtggtactgttgctttgacgcaatttataaattctcatctgaaaataactcccgaaatgaaagctacgggaaagcagggacgggtgatttatagtttcaatgtggatatagatggttcaatgaaagattttcggctggtgagaggacttgatccattaatggatgccgaagcattgcgggtacttcaattagtgaatgaaaaatggagtacggggtattatttcaattcaaagaaatggtatcgggagttttatgtgaatcaattcaccattcccattatttttagttggtagcttatacatattgctactttggacttgagatttcgatgttttgacagtttttggagtacacctgtaacattaaggaggattaccgttcttgaaggatcattttgttcttcggtcaactttcggaagtatctctgacctgtcagcttttcgatacaggaacttcgagcatgtatgccctcatgctctcattgtgtgtataacaggctaattataaattacttatgtgttgacggtaaaaatacttgctctcacttatactctcatgccctcactatgttttgaagtttctttttacataacatgcttgttgtcagttatgtatattttttacaggctgtttgtgtttgatgcaaagtaggacattttcaggcttttctatcgtaagaagtatgcatgagaagggtttctacgaaatgaggcttacgatggaatttccggcaggggtaaaaaagatcaagacgtttttaaaaaagctcttgttcttttttaaaaaggcggttatctttttttaaaagctcttgatcttttaaaaaaacgtcctgtcaccaacgacaggaagaatataaaaacaggctgtaccaatcatttgatacagcctgtttttatatttataagattatatactacagattagaagtacagataacggtcatctttcacttcagcttttttgtagaggtcattgatgaaactgctagcataacgtcctgccatattagacaagttgttttcttcgtttttagcatcaaattcttctgcacttttttctttgttataaacctgaatcatgtaaacacctgcattacccttgataggaccagttaacttgtttacttcagctttgcttgcataagcacctaaagctggttcgctggcgcgagttactgaaacatatgccggagcagagaaagtgatatgttttacagaatcgctaactgcatttgccatatttttcacttgggcaatgctgtttgcgcctttcatttcagctatcagtttttcagcttttttatctttgatgatttctgctttcagcatgtcggcaaccaagttgatattacgatatccggcaggattaatcttttcaagagcaactaccatcagatgatcgttctcaccacattcatacaatggagacacttcaccttctttggctgcaaaaatccatttcaacgcttcacgggttccttttacaccacccacacggtgttctgcgctacggaaatcagcacgttctaacaagcggtatccgctttcttctgcattggcaacaatcttatccattgtagtgttctgcgctacgaattggctgaaatcattgtatgccttgttgtatgtttctttgctgaattcaaccggacgtttaatcactgcaactttatatttatctttcatggcttttttatccaacacttgaagaataacgttagcttgtccgatctgaagattgcttaattctttaacattagaattaatcaatgtgttgatgtatttagcattgtcagcatctaatgcagcaccttcatagttgcgtgcagtcaaccaggttgcttcacctgtctgaccatatttttttgcgatatcagcaaagtcagctccatctttcagtgcattgaaaatactatcggctaaagttgcggttttagcagcatcttcagcatatacctgaatttgacgatattggattgaatcgggagcagtctgcttggcaataattttaaaagcattatatgaatcatctgcctgattatagtaaggaccatatacttcgttgatagttacagagtccaaacgagcaactacatcattaggatatacagtcttgttgattgcaatttcagaaaaaggaacaacagagccggtggaacggatgaatgtgttcatgtcggcagcggtacctagctggttggcatattcggttacttcatttaatacttctttgcgatcttcttcagatggagttaccaatacatcaatgtatttgatgttacgagtttcaaccggctgttcgaaagaactttttttcttgttatacagatctttgatttcgctgtttgaaaccgtgatagttgaatcgctgatagaagaataaggaattgcagccagtaaaacgtctgattgttcagtgcgtgatgtaaacgcatcttcagctgcaaccggatttgagatcaatgattttgcaatcaggttctgatatttttcagctaaagtagattggatcaaagtcttttcaataaaattccaaaaagctcccattttttgatagtattctacatattgtgcaggcattttgcttgcatccaggtgagcgtaatctaccaggaattttttcagcatatctttgtcgaaagcaccggtttgcggattgcggaacggagtttgcattaataaggggttagtaccctcctcaatgattgcttgaacttcagctttgctgacagtcagtcccaattttgcagcttctgctgcgattaattggttatttacgtaagattgccatacttggtctttcacttgagtcagttggtcgtcatttaatgcagaaacaccttgtgtcaatttaatgacttctgtgtattcgtctaccattttttgatactcttgtgctgtaagtgtttttccattcacttcacctacgtcttgtttaccctgatgtggttggagaaccttccatgcgtctccggcaatgaatgcgaagagggcaagtccgattacaacgaccaacagagggcctttacttctgattgtttgtaatgttgccatttaattttactatttttgtttattgtttttttatacttcatagatttagcgcacgaagatacaaaaaatgcagcttacaagctattttattgtgaaaaaaatctattattcggttactttcaactttactaattcaattttggttgctgttactttaattattttgaaatggaatttatcgaaagtgatctcttcatgtattttggggaagctttggtattggtgcaggatgagtccaccgatagtttggtaatcatcattttccggtaggccaagtgagaacaattcattggctttttctatttccagacgtccggaaaggatgtattcattgtcaccgacagatttggctatgtaagaagtcgtgtcatgctcatcttctatttcaccgaaaatttcttccactaaatcttctagcgccacgatgccggatgtacctccgaattcatcgactactacagctaaggatttcttttgctgcatgaatagtttcatcagcttatgcgctcccatcgtttcgggagcaataggtagttggcggacactcttagtccagtcggtctgttcacgaaacatttcagaagaatggatataacctataatattgtcaatgttttctttatagacaatgattttactgattccgctttcaatgaagcgggcttttagttcttctatgggagttccatattctatggcaacaatttcggttctaggtaccatacaatccctaattctgatattcgaaaaatctagtgcattttggaatatcttgacttcggtgtctatgtcttgttcattttgaacatcttgtatactgctttgaataaagtaatctagatcgactttggtaaaagctttttcattggcttctttatttgttttaatgcctataatgtaaagtaatatattggatattcccgaagcaaacttgctgatgggatagagcaagacatagcaaatgtaagtgggaactgcaaaaatattcagagtgaaattgggattaatcttaaataaggttttaggcaggaactctcctgtgaccaagatgattaatgtggaaataattgtttggatcagtactaataaaaagtggttgtctatcaatcctgccagcaagttttgttcaatgacttgtgccatcaatataccgtaaatgaccaaagcgatgttgttccctaccaacatggtagagataaaattgttcggattatgaaagaagatggaaagtatacgtgaatttatgctttggctgttacgatccatttcaaaacgtaatttattggatgaaacaaaggctatttccatgccggagaaaaaagcggaaaaagccattgtgataagaatttgtataataatacccataatagtgagtgaattagcgtatcgaatcagttctggtgctatttgcaacagcttttgtactgtctgctggtgctgtatcttctacagtgaaaatacctgtgttattataaatttgatattctgtcatttgctggttggattcaaatccataaccggtaatgattttgtcttcttgttcaatgcggataaatttgtcagaatagaccctttcctgtttttcatcccaaaagagcaggtctgtgtcaaatttgtcgcctctttggctgcggatatgcacattgcttctcaattcccaaagtttctttttctcgtagtaataggctgtatcggcttttatgctggcatcaatatggaatagggaatcaaacttttccagataaactcctttttcaaaagcccaataaggagggttctttttatcataaatttcccattcttctgtgataattttgtagcgggtaataccggaatcggatataagggtagtaacccccaatgttttcatgctaggcaatgaatctctttctgtaatggcttccgccagatttttttcgcctcctgagcatgctgggaataaaacaaacataacagttgcccaaatggcaactgttatgtttagaaatataaagtgtgattcttgttttttttcagacgacataattatctgatagttgttgtttcaccaatccatccaccgattgtaacagagtcacctttcttcaagctgaggaagaacaagtctgcgtctttaggagtatgggctgcataagtaccaattagtttatttgcttcttcagcaacactaggatctacactttttgctttctgtaatttgtcgataacagcaaaataagtacacttgttcaatgcggcttcatcactccagttagggcttgatgcatacatattagcaattaaaatgtaaggcttaccattgtttccatccaatgagattgacttcagcgcatattgttttgccttgctcaactgttttttgctgaataaaatagcagcggttttgtatgcatagtcggctttctttaatgggtcttgttctaagttgatagcctgatcaaaatagtcgatacatttgtccatatcacctttcttgtaatacatgtatccgcaacctacagcagtttcggcagtcggttcgatggcatgtgcggcttcagatgcagcaaagtaagcttcctgttctgtacagtttagcatctgcattacagaaataacttgcttcagataatccaaattagttttgttttgttcaactttcggagcatagatagcttgtaggttgtcgcaagtcgctacaccactgttaatgaaaaatgcatcgatattgtcttttgccactttcaataattttttgtcattttcctttgtagcagcttttaaagctccatcagcaactcctgatgcaaacaagtaatcctgaatgaattgttctttgtatgcttcatcactcttcattttacgggcagcagcatccatgaattcttgtaatacaaaatagtcggaattttctttttcaagttcaatggcttctttgaacatgttgtatgcttcattcatgtcctgtccacccattgtgaagtagtcatgtgccttcattccgataattgaaccctttgtagcatctcttttaaccaacttgttcaaatcgtccagatattggatacgctggtcgtgaactttcatcagttcattgaagtattgtttttgcttagctgcatctttttcaccggctattaaagcacgaagaatttttgcaccattagtataagtacttacttgagctttgggggcttctgtaaatacgctcatccaaggagtataggcgtccttgaaattgttagttttgacatactcagtgtaaatactgatatttttcaagcatcggatactgtcttcaccatgtccgaatcttgatccgtctgacgctccggtctgagcgaaagaagctgttgtacctaaggaaagaacgaacagcgctgttaccatcttcattttcatcgtatataaatttagttgttgttatttatttgcttctctccatttatcaatccactttccatttcatgaaccaacgttcattgaaagtgagcccgatattgattctcaaatagttctcttccattaatcctttaaatttaggactgactttaatgtattgtccggaaatgttcagcatagatttactttggaacatgggaagtccgaaacctacactgacgccatattcgcgtgcaccgtcttgaaaactggttgctcctgtgtccggatcagtatagcttaccttattataaggagttgaataataagctcccatacggtaacggatacgcttcagatagttgtggctgatataacttggtacgaattccgcaccaaaagctatttttgtgcggttattcatttccacactttctttgttgaacttgctccaagtcagatcggctgtattccatttttgtaaagtatagtcaaccccaatcgtcaggcggttgtcatatacataagtaagacctgcaccaaatgtatgtggcattttaaacgggtttggaatagtatcgccagtttgtgactgtacataaatggaaccattactttccgtacctgtctgatgatatttatatgcatctccgtgcaaggtatgtcccagtgtataaacggcacctacatttattgtgtttttcttgtttaacttataagtatactgtaaaccaaaatccaatttataatcactgatggaaaatttgtctaatttgatactacgtgtatctgtcgctccaatagctgtcatggattgatgggtaatgtctccataaagatatgaaaaatttgcaccaacagacaaattattaaatactttataacctaatcctacaaaaacctggtgaaagcctccgtcgccattataagattcgacccactttccgttattgtctacatcctcaaaatcatgtgttttggaaatgttgtaacctactgtagaaaatggaagaaaaccaactgtcattcccattttttgccatagacggaattgcatggccaaatagtcaaaacttgagtttttagcattggtttttacattaccatccttgaagttcgcattttgaagagtcattcctgcatcgaacaagaatgtcaatgaatcgatagctgtataagatgccggattagacgcgttgatttggtagccgtttcgcaaaccgtatgctattcctcccattgctttactgttaccaaaattttgatcagctaactgaccaaagccgtagcgtgtatagggagaatttgtgcttgtttgggctacggccagccctgtgactgtgagtaatattgacgcactaatcagtcttttataatttatcattatagcttaatattctgtttaaacctttcaatactaaaaatctatctgcaaagatgatactttttaattttgtatcaaaagaaaattcatctccgcccgttaaaaaaaccaaaagctccggataattcttttgaagatgggtgatatagccgctcatttcaaattccattccgcgaatgactcctgcccggatagccgtttctgtagattgtccatacatcggaacttctcctttagcgcttactttgggaagtttgtcggtgaatatgttcaatgccttgaaacgcatacgcattcctggagaaatattgcctccatgataggctccgtcagcgtcaataaaatcgtatgtgacacaggttcctgcgtcgataaccagcacatcgtgtccaggcttcagccagtttgctgcgaccacagctgctaaacggtccatgcccagtgtttgaggcgttttatataaattagtgacgggaacaggggtttcatgacttaattcgatgatgttaaaaggcaatctttccagttggtgccggatcgtattgcttagtgttatgacagaagctatgatacctcgtttcaacgggtatcgggagcaaagcatcgggaggcaatctaaagaatgattggagccacgaaatacttcaactaactcgcctttgtcgaatatagccaatttggctactgagtttcctatgtcgattattaaattcacaactttgctttttcggctgcaaagtaacgcaaaaaataaataggaatagcaataaaaaatggtatttgtgaggaattaattaatatttaggtgtacttttgcatcggtaaacagagaatggaatttatgaataaattaattatagcattgatattgttattctttttcttgggtcaatcggttagaggtcaggaagataatataaaggtaagtctgatgacttgtgctcccggtacggaaatatatgctttgttcgggcatacggcattgcgctatgaggataaggcacgtggagaggactgggtgtttaattatggtatgttcagctttaatactccccattttatctatcgttttgtcaaaggagaaactgattatgaattgggcgtaacccgttatccttattttgaaggcagttatgctatgcgtggttcctcggtttatcagcagacattgaatttgactatttcggaaaaacaggaactcagaagattgctggaagagaattatctgccggagaatagggtttaccgttataactttttctatgataattgcactacccgtgcgcgtgatgtaatagaaaggtgtattgaagggaaggttgtttattctgaaggaaaggaggggctctcttttcgggatattgtccatcaatatactaaaggacacaaatgggatgagctgggcattgatatgtgtttgggcagtgaagctgataagcctattgatgcgcgtaagcagatgttcgcccctttttatttgctggaagcggcaaaaaaagcgactatagtagtaggtgacagcgtgcgtcctttgattctgcatgaaaaaaaggtggtggatgcagaaccggagaatgttggtgacggttttccattgtcacccctggcgtgtgtctttattttaataggaattacttgttttgtaggatggttgcagtttaaaaccaggaaaataatctggatttgggatttgcttctttttggtgtacaagggttagcgggatgtgtcattactttcctggtctttttttctactcatcctacggtagggtccaattggcttatccttttattgaatcctatccctttactttaccttccggtcatggtttgtcgagctataaaaggtaaaaaagacctctatcatacaataaatgtagtgtatttaacactttttataatgataatgccgtttgtacagcaaaaattcaatgtaacggtattacctttggcactgtgtttgttgatatgttctgcaaaccacgttttattatattacagacaaaacaataaatgaaaggacgcatcttaacttctcttttgactgttatcgcattaacagggttgcaggcacagaacattcctgcggttcccaggttggtggtcggattgactattgaccagttgcggactgattatatagaggctttttcggctttatacggtgaacgtggtttcaagcggttgtggagagaaggacggatttatcggaatgccgaatatgactttattaatgtggataagtcatcagctgtagcggccatttattctggcactacaccttataccaacggaatcgtgggggataactggatggaccgcagtactctgcgagtccttaattgtgtggacgatgctgattttatgggtatttacacttccgagtccacttctccgcagaaaatgaaggtgtcgactttgacagatgagttggtaatagccacacaaggaatagctgaagtttattctatcgctcctacacgtgaaatggcggtgttggctgccggtcatgcttcgaaaggtgcattctggttgaatgatgaaacaggaaaatggagtggcagtacatattatggtacatttcctgcatgggtgactacttataatgaccgtgaaggattggatttccgtatcggcaatatgtcgtgggagccttatttgcctgtgactgtctataaatatttgactagcgagaacaaacaagttacgttcaagcataatttcgatgacgagcggaaaaataaataccgtaaattgaaaacaagcccttatgctaatgatgaggtaaaccgtttggttaatgcttgttttagtaatacttccattggaaaggatgctgttccggactttttgtcactggcatattatgccgggaattatgatcataaggctcctgcagaactcccgatggaaatgcaggatacctatgtacgtctggacaacagtattgctgaattattggaattgatagaccggaaagttggtttgaacaatactttattctttataacctctacaggatatgctgacgctgatcctgttgatcctcctcaatataaaataccgggtggagaattccatattgaacgttgttctgctctgttgaacctttatttggctgctatttacggtgaaggacaatgggtggaggcgcattttgagcagcaaatatacttgaatcataagctgatagagcagaaacaactgaatatatccgagatattaaatcgtgcggcagaatttttggtacagttcagcggagtgaaagatgtgtattcttcacaacgtttgcaattgggagcgtggactcctaccattgataaaataaagaattactataacccgatatgttccggagacttatggatagaagtcttaccaggctggactgtattccgtgaacattcgcttgatacgcaggtgcaacgctattcatatgcgtcggctccattgattttcattgggaacggaatgaaaccggaaataatccatgcgcctataaaaataggcaatatagcacccaccgtagcccattacatgcgcattcgtgctcctaatgcagccgttctggcaccaatgacagacatcagaaaataatattaaggagagaagtgcaaataaatcagcattttattgtaactttgcactttcaaaagtaatcaaattagaaaataataaaaacaaaaaatacaatgggatttaatgaatttattggcaaattgtttggaaataaggccactcgtgacatgaaagaaatcaagccatgggttgataaaataaaggctgtttatccggaaattgccaaattgagcaatgacgagcttcgtgcaaaaacagtagaattaaagaagtacatttctgattcggctgctgaggaacaaaagaagatagaagaattgaaaggtactatcgaaactacagaactggaagatcgtgagggcatcttcgcgcagatagacaaactggaaaaagaagtgctggaaaaatatgaaaaagcactggatgatgtacttccgcaggcttttgccattgtaaaagacactgcacgccgtttctctgaaaatccggaattggttgtaaccgctaccgattttgaccgtgaattggctgctcaaggaaaagattttgtgcgtattgaggacgataaggcgatttggcagaaccattggattgctggtggtaatgacatggtatggagcatggtgcattacgatgtgcagttattcggtggtgtagtgttacataaaggcaagattgccgaaatggctactggtgaaggtaagacgttggtagccactttgcctgtatttttgaatgcactgaccggtaatggcgtacatgtagttactgttaatgattacttgtcaaaacgtgactcggaatggatggggccattgtatcagttccatggattgagtgtggactgtattgataaacaccagcccaattctgatgcacgccgcagagcttatatggccgatatcactttcggtacgaataatgaattcggtttcgattacttgcgtgacaatatggctgtcagtccaaaagacttggtgcagcgtaaacataattatgctattgtcgatgaggtggactctgtattgattgacgatgctcgtactccgttgattatttccggtcctgttcctaaaggtgaggatcagttgtttgagcaactccgtcctttggtagagcgtctgtttgaagctcagaaaaagttggctacccaatatttggccgatgccaaacgcttgattgcatcggatgacaagaaagatcaggaagagggatttttggcattgttccgtagtcataaggcactgcccaaaaataagccgttaatcaagttcctaagtgaacaaggtattaaggcaggtatgctgaagaccgaggaaatttatatggaacagaataacaagcgtatgcctgaagccactgatccattgtatttcgtaattgatgaaaagcaaaacagcgtagatttgaccgacaaaggtattgacttgattacaggaaatgcggcagatcctactttattcgttttgcctgatattacttcccaattgtctgctttggaaaatgagacagatttgacagaagaagaaaaactggccaagaaagatgaactgatgacaaattacgctatcaagtctgaacgcgtacacactatcaaccagttgctgaaggcttatgccatgttcgaaaaggatgacgaatatgttgtaatcgacggacaggttaagattgttgacgaacagacaggacgtattatggaaggccgtcgttattctgacggtttacatcaggctattgaggccaaagaaggcgtgaaggtggaagctgctacccagacctttgctaccatcactttacagaactatttccgtatgtatcataaattgtcgggtatgaccggtacagcggaaacggaagcgggagaactttgggatatttataaattggatgtcgttgttattccgacgaatcgtcctattgcccgtaaagatatgaatgatcgcgtttataagacaaaacgtgagaagtataaagctgtcatcgaagagattgaagaaatggtaaaagaaggacgtcctgttctggtaggtaccacttcggtggaaatctctgaaatgttgagcaaaatgcttgcaatgcgcaagattgagcataatgtgttgaatgcgaaactgcatcaaagagaggcggatattgtggcacaggcaggtcagaagagtatcgtgactattgctaccaacatggcaggtcgtggcaccgacattaagctgagtccggaagtgaaagctgcgggcggtttggctattatcggtacggaacgtcatgaaagtcgccgcgtggaccgtcagttgcgtggtcgtgccggtcgtcaaggggacccgggctcatctgtgttctttgtatcattggaagatgatttgatgcgtttgttctcttcagatcgtattgccagtgtaatggataaacttggcttcaaagaaggtgagatgattgaacacaagatgatttcaaattccattgaacgtgctcagaagaaagtggaagaaaataactttggtattcgtaaacgcttgctggaatatgatgatgtgatgaacaaacagcgtgtggctgtttataccaaacgtcgtcatgccttgatgggtgagcgtatcggtatggatatcgtgaatatgatttgggatcgttgcgcttatgctgtagaattgggcgactttgataatgtgaagatggaaatattgcagacattggcaatggaagtaccattcacagaagaagagtacaacaagatgagaaaagaagatcttgctgagaaaacctttgaagcggcaatgaacaacttcaagcgcaagacagaccgtatggcccagattgccaatcccgttatcaaacaggtatatgagatgcaagggcatatgtacgaaaacatcatgattcctattacggatggcaaacgcttgtataatatctctgtcaacttgaaggcggcttatgaaacagaaggcaaggagattgtgaagtcatttgagaaggcgattctgcttcatactattgatgatgcatggaaagaaaacctgcgtgaactggatgaactgaaacattctgtacagaatgctagctatgagcagaaagatccgctgctgatctttaagttggaatctgtcaatttgtttgacaacatggtaaataagatcaataacaataccatttctgtattgatgcgtggacaaatcccggttcaagaaccggaacaagttcgtgaagctgctcccgaaccgcaggctcctcgtcaacagtatagagaggaaaagcaggatttaagtgatcctcaccagcaagctgctgccgaacatgacacccgcgaggtaaagcgtgagccggttcgtgcggaaaagacagtgggtcgtaacgatccttgtccttgcggaagcggtaagaaatataagaactgtcacgggcaaaatgcgtgataaataacgattattatagaaacgttcgggtagaatttactacccggacgttttttttattccttttaacttacttcttacataaataagcgtatttttgttccctaagaaaaaatgataatatgaaaagatccgcctcattaataattctagttgccgggacactttttgcttcctgcagcagtttgcagaccatatcttttgaccagttacaggcagccgatgtcagttttccggatgctgtgagaaaagtggctgtgataaacaatatgcctgtactgaaaactaaagataatcatgaaatactgagcagcgaattggaaggcgatggtaaagtggcatccgaagctttggcagagaatattgccaatgtgaattatttcgatcaggtcattatctgtgattctgtattccgggcacaggataaagtgccacgggttaatgtcattctgactaaagaggaagtacggaaattgagcgaggacttgggagtggatatgatattgtcttttgatcgtattcatattcagactaagcccggcgtactgttctatccggattttcctatgcctatagatgctgtagatggaattatatctccgattgttagagtatatattcccaatcgtgataaacctttgtttgtagttgccaagcaagataccatttcctgggaaatagaaccagctctttctgaccggaagatagtaaaagaagcttcggaatatgccgcttctattccagtagaacatctgttgccacattgggatgaggtggctcgtttttattacgatggcgggaatattgaaatgcgcgatgccggtgtatatcttcgtgagaacaattgggatgaagcgtatagtcagtggaagatagcctatgagaagagaaaaggccagcaaaagatgaaagcggcttttaatattgcactatattatgaaataaaggataatgtagaacaggccaaggaatggttgggtaaagcgaagaatttggtgaaatcaggcagcagggatgaacaattgatagccttttattcattggagttagagaaaagagagagtaagctatcccaattgagaatacaaatgaaacgttttgatgataatttttagagaataagtgttgagagaaagattttttttgtacttttggatataaataatatataaaattgattttggtatgaaactcagtgcacagtcacatgcttctattgcgtcttcgcttcgggaagcggttgataaatatatagcggatggagagagaacggtagtcaccgatatccatttgcaacctaagcaggacagtggtgaattagttatttttaatgatgatgacgaagaattgtcacgtaccataattgaagagtgggtggattatagtgaagatgatttttatacaatagtagagcgtatacttcgtggggagatcaacgcattgaaagatacgggagttttggataagttagctataatgaagccttattcttttgttttggttgatgaggatagggaaactgtaaccgaacttttattgatagatgatgaagacactttattgctgaatgatgaacttttaaaggggttggatgaagaattggatgcatttttaaaagacttgcttgaaaaatagataaaataataggagcatcgggatagtaaagtttccgatgcttttttatatcataggtgaggaaaatgttttttcaagagtggcgtttaaaatattgttttctcatccatcggtcaaaaaccatgaataagggtatagttatgatgaatagcagataaatgagaggaatttgtatttttaaaacatgactgccagcaagaaatgcatgatacatagtttccttaatgtgatttccaaaataaatatacaggccgatgctgccgcttattattaagaatagagaagcagcaatagtagctagtaacatctttctctcctgtttcttttcacgtaagagtatagcttcctctactttctgcatggtgcggaaagtaaaattggaggtcagccggaattggggctgttcttttacagccttcattaatcctttatctttttgtttcttgttcattctgcttctgttatgagtatatataatttttttcttattcgatgcaattttacttttgcattgctttccgtcagtcccaggataagagcgatttcaccgatagttttctcttcattataaaatagggaaatcaaggcgcgttcttctgcatccagtttcttgatggccttattgagctttcctacccgttccccgctttcatcattcagggcatcgtctatttgctggtcggatatattcattaacatggcactgtccataacaattaactcttgctttctttttctggttgccgatatggcggtgttatatgcaatgcggtatatccatgtagagaaactactctctgctttaaacgacgaaagatgttcaaaggctttcaagaacgtatcctgggtcaactcttccgcatcctcctgattctccacgatgcgtataatcaagataaatacttgctgactgtatttatccaagaagtattcgtagagagaagtttctccttttaatatcctatgaataatatgtgtttcgtcgttttccattttgtctattagacgcagggctgggagagaggttacataaaaagagaaaatatttttttctttctcaaaagtgtaacctctttggctacgcagcgtctaatgaatacaaaggaacaaaattaataacttaaatacgaataaattatgggttacattaccggttggattgttgtaggtatcattacattaggaatctacaaattatttgaactttttgttggtaagaaagagcgtcttactatgatagaaaaattgggagacaagttagatccttccatgttggggaacaggcttagcctgcctcttcctgtaggaactcctttcatgtcatcttctccgatttctttttcggccttgaaatttggctgtttgttgctgggtatgggactaggcttgttgactggttatattatttgtgcaaccacggttcccgattatttcacagagcgtaattggcgcatgagcgagttaacttcattgatttatggtgcaaatgtcttgctttttggtggtttgggcttggtagttgcttttatagtagaattgaaaatttctcagaaaaacaggaaagatcatacccgttgaataatgaaagacaattagaaaaaagaaagagatgtgtcaaaatttgaagtaattatcaaaactatccgagctttgcagcaagacaatagcagaattacttttgacacatctctttattaaaaaagaagtgatgaccgctttacatagaatgttgcaatctctgtaaagcggtatatttttttattttttcaaagcagcaatactttcttttaaagaagctattttgctttctgcatcagcctgtttcttgcgttccatatcaataacgttggctggtgctttgctgacaaatttttcattgcttaattttttcaatacactttgcaaaaagccttcctgatattttaaatcagcctccagttttgccagttcttcttctgtgttgattaaattgcccaatggtatggcatattcagtggtacctaccataaatgagccggagccgtcagctttattctctacggcttcgatagaagagaggttacacaatttagtaataacaggattgaatgtagctactggatttacatctactacttgcaactccaaagtttctttctgtgcaatgtttttctgtaaacgaatagtacggataccaccgattacttctttcactacttcaaattctttgacgataatctcattacaagcagtcggaatgttcaattgctggaccatcaggctttccccttctttgcggtcatatatatgttgccataactcttcggtaatgaaaggcatgaacggatgcagcaacttcagcaagttatcaaagaagcctaaagttttttcataggtcgctttgtcaatgggttgtccgtatgccggcttgatcatttccagataccagcttgagaattcgtcccagaataatttgtatacagccatcagtgcttcgctcaaacgatatttgccgaataagtcagctacttctgcagctgtttttgccaacatggattcaaaccattcagtggccagtcttgcatattcgggctgtgcaatatcggcaacttcccaacctttcaccaagcggaatgcattccatattttgttattgaagttacgtccttgttcacataacgcatcatcaaataaaatatcgtttcctgcgggagcggcaagcatcatacccattcgcacgccatcggcaccatacttgtcaattagttccaacgggtcgggtgaattacccaaagactttgacatcttacgtcccagtttgtcgcgtacgatgcctgtgaaataaacgtttttgaacggcatatcacctttatattcatatcctgccataatcattcgtgccacccagaagaaaatgatatccggtcctgtaaccaagtcactagtaggataatagtagtttatttcttcattattaggattattgataccgttaaataaagaaatgggccacagccatgaagagaaccaagtgtccagacagtcatcgtcttgacgtaaatcttccattttcagattggtattaccggttttttcttgtgccaacttcaaagcttcttccgctgtttcggctactacataaccgccttcgggcagaaagtatgccggaatgcgatgtccccaccaaagctggcggctgatacaccagtctttgatattttccagccagtttttgtaggtgttcttgtatttggcaggatagaatttcagttcatcattcattacaggaggcaatgccatgtctgcaaaatgttgcatcttcaagaaccactgcatggacagtttcggttcgatggctacattggtacgttccgagaaacctaccttattagtataagcttctaccttttccagcaatccggcagcttgcaagtcttgttcaatctgtttacgtacatcaaaacggtccatacctacatacagtccggcagcttcgctcagtgttccgttatcattgaagatatcaatgctgggcaagttatatttttcgccaagcatatagtcattcacatcatgggcgggtgttactttcagacatcctgtaccaaattcaatgtctacgtagtcgtcttcgataaccggaatgatacggtttaccagtggtacaattacctttttgcctttcagccattggtttttcgggtcattgggattgatacacatggcagtatctcccataattgtttcgggacgagtggtagcaactaccgcatagcgtccttcagcatcaccttctactttgtaacggagataatacagtttgctgtgttcttccttataaataacttcttcatcactgagagctgtcagtgcttttgggtcccagtttaccatgcgtacaccgcgatagatcaaacctttgttgtaaaggtctacgaatactttgatgacactttcgctacgttcttcgtccatggtgaatgctgtacggtcccaatcgcaggatgcacctagtttgcgcagctgtttcaggataatacctccatgttcttcagtccatgcccaggcatgtttcaggaattcgtcacggctaaggtcagttttctttataccttgtccggccagtttgttcaccactttggcttctgtggcaatggaagcatggtcggttcccggcacccagcaggcattcttgccttccatgcgggcacggcgtactaatatatcctgaatggtattgtttagcatgtgtcccatatggagtactccggttacgttgggtggtggaatgacgactgtgtaaggttcacgtccgtcgggttttgaactaaagagtttgttgtccagccaatactgataccattttccttccacgtcagcgggattgtacttacttgctaattccattttatattttatttatttaattgattatcgcataattgagtgcaaaattaataaaagtcgttggattattatgtacttttgcactacaaaatgatattaataaactgattatgcatacaagaaaagaacaaatggaagcatttggccgcttcctcgatattttagacgagttgcgagagaagtgtccttgggatcggaaacagacgaatgaaagtctgcgtcctaatacgattgaagaaacttacgaactttgtgatgctttgatgaaggatgacaagaaggatatctgtaaagagttgggtgatgtgttgttgcatgtggccttttatgcaaagataggtagtgaaacaggagattttgatatcaaggatgtgtgtgactgtctttgtgagaagctgattttccgtcatcctcatgtttttggcgaagtgaaagccgagactgccgagaaggtgactgaaaattgggaacagttgaagatgaaggaaaaggatggtaacaaaatggttttgagtggagtaccttctgctttgccttcgctaatcaaggcataccgcattcaggacaaggcccgcaacgtgggatttgattgggaggagcgttcgcaggtttggactaaagtaaaagaggagatcggcgagtttgaagctgaggtggagaacatggataaggagaaggcggaagcggaattcggtgatgtaatgttcagtcttataaacgcggcccgcctttacaagattaatccggataatgcattggaactcactaaccagaagtttatccgtcgtttcaattacttagaggaacacaccatcaaacagggaaagaacttgaaggatatgactttggaagaaatggatgctatatggaatgaggctaaaaaggaagaaaaatagtagggttggaagtgttttttatgatgtgtgctatttttgtcttgcttgtttttctgttttaatcaataaagggtattgtatttattctaggtaatttaatgtatggtgatatcaaattgtgttctataagaatgaggggctgtcttttttatgacagctccccattctttatgaaataagttttatatgaattttattctacccattctttgatggcttgtgaaggatcaggatttaaaacagcacctttgttgaatacattttcataaagactgataaagatattcatccagggcgcacagtagccttctattgaattaaatcgatatccgataggagcattagtacccggataaccacgaacaacttgtaactctaaccgtttgtaatcccaaaagatgatcccttcaccccagaattcaatacgtttctgttcaacaaccttcttttgaaactcttttagatcatttgctttacatgtatagctacccacagaagtattataacgaaatgtatttacgaaatcttctaatttagaaataccggctgctaatccttggctcattcctattgcttcggcttcgattaaatacatttcctctatacgcattaacggatagtcaacggcagctccgattgtataatcgttcatttctccatttttaggtcggaatttgatacctgtatatggaggcatatcagcgaaatcatcatcggtcaacaaagttctatatttagttccgggagctttgtgtgcatcttcaggagcaatccaagttgtttttcgccagtctgcatttggtatttgatcgaacaattttttgccgataagcttgtatccttgccattttcggttaccgtaaccgaaagtttgttcaggacacatgcttccggcaaagttgagccaatagctatgtacatcctcggtagtcatgatggatccccatacccatgaattggttagtacactgttgaagccggtagtatagctgtctccaccaaaccattccttttcggtcagaggcattgctccgctttcgttaatgactttgcgtgcgtattcggctgctttagtgaaacaagtttcttttgatgcaatgtttaaatctgtattgttgtttagggtgttgagatcttcagggtaaagttcgaaacgagatcccatttccagccacatacgtgccatcagaccatggacaaccggggtacagggcaagtttttggttgggcgttgataatcactcaaaagctcctcagctgaggctaggtcatctaatatgaatttgtatacggcatagaagggagcacgtggattattacgcccttcttcttctgtggtttcagcggtaataataggtacggttatgccatataaatttttactggctgcttctgcatctaatttctctactcctgtttttttatattcatacattcggactaagtccatgtatatcatggctctataagataggcatatacctttataatacttgttttcgggtgcatcatctgctttttctaaagcactcagtgcattatttacattattcagaaacttgtagttataataccaaatggtattgacaacatcggcatcacccaaatcattacatactccataagtatcaaaaaagtcaaatttgggttcgtggcagaagaagtcttcgcatgcactttctctgattaaattatatccactatatccaaaatcatgataaaattgtggaccgtaacttctaaatgcattaataaatgcgactactgaatttaccattgcgctgatagcttggtcagattttcctatttggtctatggtagctgtgctactttctggaaatacctcttcgatacaactgtttaagcttaatgctgatgacagacatgcagcaatcattagtttggtaatatatttctttttcatattcttgattgtttatgtgttgattagaattgtaaacttagaccggcggagaatgcgcgtacggctgaatattctccggatgaatctttatttccgttccatgttacgcgtgaatcgaaaccttttctttttgaccaataataaacattgtcacaggccacataaatgcgcagattagttagatatagacttctaagtgtttttttgctgaaagtatatcctaattgaatgttttgaatacttatggaagatgcattagttagaaacctgtcggatgtttttacactgtacaggtcattgaattgccattgtggaatatcactttgagtattctccgggctccatgctttataaatatctttgtgaacattgtatcctaaatgagttgaagtaggaggtgacattaatgcttggtaaccatagtcgtatgcctgacctcctatactgtagtttatttgtgcagagaaatcaaaaccataaaatgaaagagaggtattgataccaccgtataggtctggaacagcgtcaccacataagtatagatcagcttgagaataggtggttgttgttttcatctcactggtttgcttatctgtataataccattgtggtttgccttcttcggacacacctgcatatttttgaacatagttagtatacattggaagtccttctccgtaataatacagaccgtttacataaccggcatgtccatctataatgtctgtttttttactttctgcaagacggctgatcttatttctataatgtgttgcattaaagccaatattccatgttacgtttctagtcttgactggtatatattttaaatcaatttcaacacctttgttattcatgtcaccaatattgtcataatagcctgagtaccctaatgataaaggtacagaaaaacggttaagcatatcagttgttctgcgattgaaatattctatgctaccacttaatctgccttttaatagttcgaattctatacctaaatttatatttgtattggtttcccaggtaatatttttatttccttttctggaaaaacctaatgataactcattattgctgttattgatattgtaagtatctacatataagaaatcgtctattctgtcattaccctgttgacctacagaaaactttagttttaataaatcgagccatttaatgtcatccaaccatttttctttggtaagaatccaagcagttcccacagagtagaaattaccccagcgattatccgggtgaaagcgggaagaggcatcgcgccggtaagaaagttggaaaaaatatttgccgtcatagtcgtacatacctcggaataaatatccttcagtattgtatttactcttataggatgactcatcgttggtaccactgatggcaccgtttaattcttgattctgaaaaaaagagaacatactgtttttggctgcgtataattcttcataaacgttattaaagctttcatgacctgccatcaatgaaacgttatgtaatccgaagctatgattataatttaatatttgttgtaggttgagggttgttcgacgccaatgctggacattgatgcttccattcaaagaatttgctgttccataaaaaggatttaaagcatttttgtaccggctgtcacgtatcgaagtgcctgcattgaatgtgaatttgaagtctttcaggaaattaatatctataaatgcgtctccattcaaagtatttgcagaggtgttatatgtatcgagctgacttaattttattccgttagagttcgggttgataggacggtttagaggaccttggttggatactccgaaatcgtacatgtcaccatttttatcctgcatgatcttaccatttgtatcacgtaggtaaagtggatatatgggagctgtattgaaagcttggctaaaaccgccagcggctgaattctgtattgaatgtgtataactgatgttggcgccaaatctcatccacggtttagcctgatatgtggttttcaaacgaccggtgatacggctataatcagacccttctgctataccgtcttcatctaaatatccaaaagaagcatagatttgtgctttatcacttccgcctgaaatattgacgttgtattcttggcgtaatgctgtatgatatacagcatcgacccaattgtcgggagtgagataataaccgtttactatccgtcctaattttgcattaggattaagaagaccgtttttaccaatcagatattctccttcaggatatgaatatacgttgtaggataaaccaccggtttgactgttggttcctatcatattagtatttgcgctgacatatgcttggtcaggagtttgtccttgggcatttaaataataattgtataatgctttatagtgtgcttgataatattctcctggatcttttatgtagtcatattctatttcaccacgggtattggcactccatttagcgtctactgtgatttttgcatcgcctgctttggctgattttgttgttataattatgacaccgttagcacctcgagcaccataaagagctgtggatgctgcatcttttagtacagaaatagattctacatctgctggattgatgttattccatcctccttcgtatggcataccgtctaatacgatgaggggatctgtttttgcgctcattgaactgatgccacgtatcagaatgcttggagtttctccaggctgcccatttgtcattgtcatttgtaggcctgccacttgtccagataaactttctatgacattagtaaccggacgtttagttatttgttctgtatgaatcatttttgcagatcctgtaaaagctgatttttttgcagtaccataagcaactaccaaaacttcttccatcacttctgttgttgaagtcataacaattttcatttccggcttgatggttacttcttgggtttccattccaatgaaagaaacaataattgttttgttggtaggtgagatgtttgtaagtgtgaactgaccattgatgtcggtgattgttccattggttgttccttttaccaatacggaagctccgattaccggttcgttgttttcgcttgagataacggttcctttcactgttacctgtgcttgtgcatggcttattcctacgaataagcatacgaatagtagtaatagtgtctttttcataatgtttgtaatagatttgtgagtttatggtttgtacaaacctaggaataaaatctaataaatcaaaatattttcgatggtaaatgtttaaaaataaaagtatattctaatcaatgtaatagaaacttaaacaagcaagaaaattaacttgtttttataaaagaaacatcttaatcattttgtcgttccgctgaactttttaaatacaaaaatccccaaatctaagttgattgatagatttggggaaaaagttggaaatatctcttgttgcttttattttttttgagattggtgcataatttttaagatatcacggtggaatttaatctctgcacgttgtaacttatatattttcttgggagataagatttttttaaagcgctgtagatattccaaatccaatttatcggcttcaatccttgctttgacaataccttctataatttgttcgtattcggcatcggttgttttaggatttttgcctttgcgtgcttgctcccatgctttatcatttactgtttttttacggtcttgtaattcgaagtagatagggaagaatttagtggcctcttcttgcgttatttctgctttttgcgtgagatatgcttcttgtctagctctgaattcttctttggtgaaaccaggtttctttttgtcttgcgcctgtagcgaaatgcttatatataaagtgataagcaaggttgccagtctttgtatcatgtggttattatttaattatacatatctgaatttgcatctgtcaagtattgatagagcgtataatcatccatcatggaatgatctaaaatcgtttcaatatattcgtctgagaattgttcagtttccgctgctgtaaaaataggagtgtcttgtttagggggacctacaacaactctgacgctgaacatcaatccacaaaacatagctgccatatatatccaaggcttgatacgttgccaagtagttattgtttcttgcggagtagaagtttgttccttctccggcaatttattcatcaactcttttgagaagttgtcgaaataaccttcgggtaccatgaatggattttttgtcccgcatttttttaatagttcatcttcttccttcatagtggttctcctttctttgttagatacatttcttttaaaaaggtttaaaggcattcttttaaaaagttctctatttttttcactgcatggtggtaggaggctttcagtgcccctatacttgttcctaatatttcagacatgtcttcatatttcatttcttgaaagtattttaaattgaatactatacgctgcttttcagggagcgtcagtaatgctttttgaaataatatttgagtttcatctccattaaaatatgtatcactttccagtttgttcaccatatctgcatcagcgtcgtctatggataattggttggtggcacgttgtttatttaaaaaggttaagcattcattcaaagctatgcggtaaagccaggtcgacattttggcttcggcacgaaaatactctagattaatccatgctttgataaatgtattctgtaacagatcattggcatcttcatgagaaagtaccatccggcgtatctgccaatatagctgttcgctgtattcgttgacaatacattcgaaggcttctttttgtcgtgccgggtcctgtaataacactattatttctttctcattataagtgttcatgttcctatttttaaattagatatccggtttatgttatggtttaatggattctattgaaatttttaatgtttcccgtgcaagtagagtgttaggaaaaatatccgatgcttcctgtaacaatatgctttcatcttcgtagcgggctgaaaaatgtcctataagaagttgttttacttttgcggtacgggcgatttctccagcttgcgaagcagttgtgtgaaaggtttctttcgcacgggcttgttcgctttgtgcaaaggtggcttcatgaaataacaggtccactccgtatatttgttctatgatatgtggcaaataaatagtatctgaacaataggcatatcggcggggaagggcagaagggatagtcaatttgttgtttggtactatttttccgtccggtaatgtgtaatcggcgccattctttatccggttgagttcgtatacggggatttcataaaagtcaatcatgtcgcgacgaatatgggcggggatctgtttctctgaaaagaggaatccgcatgttggtatccgatgacgtaagggaattgtttctatggttagcgaacggtcatcataaattatttcagctttgcccggatcaaaagtttggaaaacgactttgtaactcatacctttgcaaaaaaagtcgagttgtggagtaagaagacgttctaattctgcgtgacagtgaatatagagtgtggctgtccttcccagcataccgaaagttgatatcagtcccattagtccgaaacaatgatcaccgtgcaaatgtgaaatgaatatatggtttagccgggtgaatttcagttttgatttgcgtaattgcatctgtgctccttcgccacagtctatcataaatagtttttcacggatatttacgacttgtgatgtcgcaaaatgccgtgtggtcggcaatgctgacccgcatcctaatatatgtacttcaaatttctccatcgttacaaagatactatcttttttgaatggaaaataaaaaatgccgtaaaaacggcattataggattgaactatttcttaagttttattttcacagcattcatgccacgtgaccctttttctagttcaaaagtcacgatgttattttctatgatattgtctatcagtccactaatatgaaagaagtatttctctgcattcttcaaatcttttacaaatccatatcctttggatacattgaagtgttctattcttccttcatgtactagttctatcggttcttcagttctacgaggagttgaaacttcaatggtggacatatccacttcttgtggtttattattaggagtgggaggagtatcggttatcataccgttctcgtctacataggcaatcatatcttcaaaggaagatgtgccgttactttttctttcttcttttttttgctgttttgctaaacgcttttcttgttttttcttttctagatctcgtttggtaaatgaaataggtttcgccatttgattctttttaaattagtaatatacagttcggcctgctacggggaagtgtatggaattaatagtgaggtaataagaaaacgggggagaagtcgttatgaaatactaactcgaaattttattactctataaagatacggttttattacggatatcccatagaatattttcctttttaagaaataatggcataaaaaaaggatgcattttaataaatgcatccttttggcttatcttaaagtaaactgattacttctttttgttttccaactgttctttcaaagcagccaaagcatcgatatcgcctaaagtggtagaggctgcctgattttggatagcaggagcttcttctctcttagttgttttctttgcattagaagctgctttcttttcagctctttcttctgccttggcagcatcttcgaaaatgcggctgtgagacaggatgattctcttggcatccttgttgaattcaattactttgaatgacagtttttcatccaattgggcttgagagccatcttcttttaccaagtgtttcggagttgcaaaaccttctacaccataaggaagagctacaacagcacccttatccaacatttcgatgatagtaccttcgtgtacagaacctacagtaaatacagtttcgaatacatcccaaggattttcttccaactgtttgtgaccaaggctcaagcgacggttttctttgtcgatttccaatacttgaacttcgatatctgcaccgatctgagtgaattcagaaggatgttttactttcttagtccaagacaggtcagagatgtggatcaatccgtctacaccttcttcgatttctacgaatacaccgaagttagtgaagttacgaacttttgcagtgtgcttggaacctacaggatacttttcttcgatagtttcccatggatcttgtttcagctgtttgatacccaaagacatcttacgttcgtcacggtcaagtgtcaggataacagcttctacttcgtcacctaccttcatgaagtcctgagcagaacgcaagtgctgtgaccaagacatttcagatacgtggatcaaaccttctacgcccggagcgatttcgatgaatgcaccgtagtcagccataacgactactttacctttcaccttgtcacctacctgcaggttagcatccaaagcatcccatgggtgcggagtcagttgtttcaaaccaagagcgatacgtttcttttcgtcatcgaagtcaaggataacaacgttcaacttctggtcgagttctacaacttctttcggatcgcttacacggccccaagacaggtcagtgatgtgaatcaaaccgtctacgccaccaaggtcgatgaatacaccgtatgatgtgatatttttaacagtaccttccagtacttgtcctttttcaagtttaccgatgatttctttcttctgctgttcaagttcagcttcgataagagctttgtgagaaacaacaacgtttttgaattcctggttgattttaaccactttgaattccattgtcttacctacaaatacatcgtagtcgcggataggtttcacatcaatttgagaacccggcaagaatgcttcgataccgaatacgtccacaatcataccacccttagtgcggcacttgatgtaacccttaataatttcttcattttcaagagcagcgtttacgcggtcccaagaacgagtagcacgtgcttttttgtgtgacagaattaactgtcctttcttgtcttcctgattttcaatgtatacttctacagtatcacctattttcaaatctggattgtaacggaattcatttaaaggaatgataccgtctgatttgtagccgatattgacaactacttcgcgtttgttcattgcaataacagtaccgtctacaacctcgcggtcgtttactttgttcagcgtaccgtcataagctttttcaagatcttcgtggctcatgctggttacagcttcgccgttttcataagcatcccagttgaaatcttcaacaggagtgatgttttttaaattttccattaataaaattgttaaaattctcagttaattacgttagacattatattgtttatctaatttcgggcgcaaagatacaacaaaatactgaaacacaaacaagtttactgaaatttcttgctgattaaaatttaaatgggatgtaatcgttgtttttaatttatgtttgtacatttgtagaaatttaacctattaaaatatggtagcgttcattttagtttgtttggttctacttttaggtcttttatggggatgggagataagaaagaggaaaagttgggaacaggagttcgttaagaagaaaaatggggtgtgtttggtgaaaaaaaaaatcggataccatattgtataatgtggatgcatatataattttggttgatcggaattttttggttgaaaagaccaattactataatttgaataatacttctgaaagataagcggaaagtaatgtccagaggctttaacggttatttgtccaagcctctgaacaaagaagctttgtttgatatgctccgccaaatgggaatttaatcttccaaagagtaatcaatggtggttacaacgcggatgcgtttgatgtaaggagtgttggcgtcacgatcctcaatgctgaattgtccctgataggctctttttatcttaccaagttcgctgtccgagtccttggcgaatttaacggctgccgcccgtgcgtttttagttgcttcctctatcatttgaggcttgatgtcgtttaaaccggtgtagtcatattgcacattgtaacgataatctccacccgtaatagcgataccttgctttaagagttcgctttgttcgctgatcatctttctcaccagatctactttagttgaagtaaccgtgatgacagaggtcacattatagcggaagggaactgaattattattataacgttcggcttgcatgtctataatttccggtgcattgatactgatttcgttttcagtgattcctttctgtttcaaaaaaccgacaattgcttggttagttgcatttattttgttatataaggtcgggaggtcatttcccaggtctttatacatcaaaggccaagttactttattagccggcacctccatttctgccagacctttcacattcactactctgtctttaccagagaaagtatccaatccctgtttgataaaataccccatcaccaacatgcctatagcaaggatgatggcttccagtttccaacttttcatacttcagttgtttttagtgatacaattatttgttttgtaagcgtccaatgcctttttaacagaaccctgttcttgcaggaattgttttgcttctgctttattaatatgtaattcgtcaatcagcatttgcactcctcggtctattagttttcgattgctgagttgcatgtttaccatccggtttccttttactctgcccagttttatcatgacggtggtacttatcatattcagtatcattttttgccctgtgccgctcttcatgcgcgagctgcctgtgataaattccggacctactatcatttcgatgggtatatctgccacactcgagagtggagagcccggattgctgctgatgcttgctgttaatattccgtgttctcttgctttttgcagtgctcctattacataaggagttgttcccgatgccgctatgcctatcagaatgtctttatttgtgatgtgatggtcttgcagttccatccagcctttttgactatcatcttcagcattttctacgggacgtctcaaagcctgttcgccaccggctataatacctatgacacaggtatcaggcataccgaaagtgggtggaatttcagaagcgtccaatactcctaggcgtccactggttccggctcccaaatagaatatgcgtcctccttgatgcatacgttctactatttcatttactagtttttcaatttgtggtatgcaggcatgaacggctgaggctactttccggtcttcttcgttgataccttccagtaactctctgacggatttttgttccaaatcctcatatatggacggttgttcggttatttttataaaattcatacttcgaaatgataatcctttaatccttccagtggactttttaaaacttttccgatggacacattcagtcttagagctgcttcttttacttcttcttgaaagaaaaatgcaatagaacctgtgaaatgtacaagaatatcatgatattcgtattgcataacattacgggtgaagaaatcagtgaagcaggaaattaatagattccgtatctctggtctgtgcttgtgggcgaaaagaaaaggagtcagacccgccagaaagcggttggctaaaggctgtcggtatactttatctaaaatcagtgccggggtcaaatcgtattctttaaggaaatcttggcaaaggtcatcgggaagttggtgtttcagtaaatcacctaccagacgtttccctaatacggctccgctaccttcatctcctaaaatataccctaacggagaaatattagctgttattttttccccgtcataaaagcaagagttggatccggttcctaaaatacatgcaattcctgccgttttaccacatagggcgtgggcggcacctaacaagtcactttcgacaaggatattcgctttggggaagttctgcgccaaagctgttttcactatattcgtcttttcgggaatacatcctgcaccatagaaataaatagttgtaaattcagtggtgtctcccaactggggaattagtgtggaggcaatcacttcttttatttcatcaactgattggtggaaggggttgatacctcctgttcgaactgtcctgctgtttgtcttggtgttacccagacaccagtctgttttggtggaaccactgtctgctattactatcatatcggataataagatgattgttagtcttacaaaaatagtataaatttatccgatatccattgttttccgtatttatttgtcgggctcttatattattttagtaactctgttcctattacttataagttagtgctttttcatataaacagacttttttaataattgagccacagcttcattgcagctatcttttctctgcttacagtaattttatctttaaatggcggttttacctgtactattatttttcctaaaaaatagttttctattttctgtatggcatgtacactgaccaatgtttgccggttggtgcggaaaaaaatatcggggtttagttgttcggacagtttgtcgagcgataaatctatgatatgctcttttccttcttttgtgacggcaaaggtaattttgttttcagaatagaaataagctatatcttctacttgcaaggtatacagcttttcgtctcctgatatcaggaagcgggtacggtattttttttccggattacttatatttttcagtaggttcagtaattcattggatgagttcgatagggtggtattgccatatctggcagttaatctttcaaacttttcgatggcttcggccaatctttccctgtttattggtttcagcagatagtctatgctgtttacagtaaaagcacgtatggcatattcgtcgtaagcggtggtaaaaataatcatactttcgggttgggcctgttctatgaaagcgaaagaaatgccatcggtcagttggatatccagaaagattatatccgggtgtggatgctcctgaaaccattttacagatccctctatgctgccgggcaatacaactatatcccagtctggccttaatcctgacaacattttatgtagcaggcgtcctgcaggaatttcatcttctataatagcggcttttatcttattcattcagtaaaggtatttttacggtgaaatattcagaatcgtcaataattgtgatatgcaagttgcaaatcagcagatagcgggcagataagttcttcagtcccattcctgattttgcaacatccttttttaatttgatcttgtttcttacggaaagagtttgatctttgtcagaataatccaaatggatgaccattggattttccatattgatgatgttatgttttatcacgttttcgataagtaactgtagggttaatgaagggattttcttgttcaataacgtgggggtcattttgttttccagttgaatgcattttcccagacgcacttgatgcagatagatatatgaatccagaaattccagttcatcacgtaaagtgacaagtccttgttcctgactttttaggatataacggtaaacatctgatagcttttgtgtaaaaactactgcgttttccggattatattctatttcggatattaaagtattcaaactattgaacaggaaatgtggatttaattgattttgtaaagccgtgtattgcgctttgatggaactttcttccagcttggttgttttttcatgcagaataaccagctgcctgtaaaaagcgctcgtgatacttaaactcacaatcacaatttctaccaaccatataatcatgatcaagcgcagacccggactgctcagtacaaatgggaaaggcagttccagcaatactttacagatggtcagagtagcgtaattcatgaagaaaagaatagctgcaatcaaaatgcagttgataatcagcttgtttctcttcttgataaagaatagagagctttttttcagccaccggttgatgactatcagactgaagcctaccagattgaatatgaacaccacagaaataaatcccagagaggagattaatattttctgatgttgaggcgtaaggtcggtatatagtaccagcgaaaggtatgagaaacatgccagccctgaaaacaggaaaaagttgaagaattgattgtatttattttgcatagccattccgctgttgaaaatgatttgggttattttacaaaaatatgaaaaaaagaggaaattcagaaaagaatagaatactttccaaatctcctcttttatgagcaaacgcttagtatggattaaaaacaaactcctacacgtacacccatgctattccttccatcttcagaataagtcaggatatcggttttattggttgcgtagctataatatacggctacatgaaatcccagacgttgataaggcaccggatgaatatccattcccagttcgggtgaaacatagaatccccacgggcgttcataccattgtaccagattgttgtaaatggagttttgggaatacatggcacccgatttgactccgaagtaaggttttacatacctgttatccggtaacttgtaggatacagatattccgaagggtagttggaacgctgattgttgctggtctgttgtcaatgaagccgttggggtgagggggatggtccggcggtccacatatcggtgattggtatgaaaattaaggaaagctcctatagcccaatagggcgtcagatcatattttccttcaaagttcattccccacccgctgaatttatcggcaaagttgctgttcaacggcacattcatctgccagtctacgttaaaatgtacattttcccaggtctgtgctttacttgtgaaacaaaagagaactagtaacattccgatgaggatacgtttgggaactctgtgttttaatattttcgttttcatgattttccggttttattgtttgtttgacagataaggagattgtgcaaatgcctgattgacggcatttaatgtcaactgcatattgaaatgggagtttccgtatagcagtcctgacgcataggcatgccagatgacaggcagtttgttctggttggacttatcggcaggttgtcttaaatcaaccatctccataatcagggttcctgtgtcatagctgtaagttaccggataaggataataccatcctcctccccagtagggcccccagaatccggcatcccaccagccgccataccatcctcctgtggtcatttgtattctttgttgggcgtatgacaactgaatgcctacattggctttttctttatcttccgtccgtacatagcctttctgttccatttcatgggccactgcactgataatgttttgggcattttcatctttccaataattggctttcaggctgttgtccggaaccagaatgctatctggcaggtaataggtggaaaactcattgaaatgtacactgttgtcataatcagtgtaaacgctgtagtcactatccagtttattcatatccggatctttctcgcacgaagtaactatcatggcaagcatgaatagtggaaatagtagcttcttcatattcctataattttagttaagtagtttatagtgagcgtcctttaaacacattggctttctttaatggcaatatttgaccggataaagtcatgtggctggaattaaagttcggaagaatatctacagtcgcattgttgcttccataaggtatgtcaatgtttacttgggctgagattccgattcccatcacgttcatactgacatgaatattaccttttttgtcggtttttactttatagttcgaagcattaccgtctacggtaatacctcctagtccgttcggaccgctgaaaggtacattgaatgctacttgcaccacggccttgtcaccgtccagtcctacaaagttggtgttggatgaaacgaaagcggaggttccgtatttaaagtaaactctgtccgcttccagtacaaaggtttggttgtctattgcctctttggcttcctgaaataacattttgtccaaagcttcctgagccgcttttttttcctgacgtgtcatttccttttctgttgtttgtgcctgtgagtattctacgcaggtaaacaaggttactaatgttaatattacaacttttctcataatacctacttttttattttatgttgttttcctattgaaatccggtataaacataataagctttgtcataaacaggtagtaatttgttactgaaacggaaaaaccggttgctgaagtgtgttttggaggagctgaaattaaaggtgtgaagaggaatgaatgagaaatgaacagccctggaaatctgctttaacaaaatttccggggcttattttctatgaactataaagtgattagaaagaccttcctttaaatatatttgacttgtcaagcggtagtatttcaccggataaagtcagacggttggaattgaagttggggcgtatatctacggtggcattgttgcttccataaggtaatgttatacttacctgagcagatatacctacacccattacactcattgtcagatatatgcttcctttcttgtcggttttgatcttgtaaccggaaacattgccgtctacagtgacacctcctaatccgttaggaccgctggcaggaatgttgaatgctatctgcacggatgatttatcaccgtctaccattacaaaattggtattagaagaaacaaaggcatttcttcctcttttaaatataacccggtcagcttccagtgtgaacgctttattttctatagcttgtctggcttcttcgaacaaggcttgttccatagctttttgcgcctctttcttttcctgacgagtcattttttttgttgtttgtgcttgtgagtagcctacgcagcaaaacaaggtgacgaatactaataaaataatctttttcatatatgtatcttttatgttattgtttggatatgaaacaaatataataattattttgttgaaaggactttatcttattttttaattaaaagcttctatgactttatattttgtacaatgtgtcaaaaagggggaggacagtatggcgaatcctggcgcaaaaaacaatggaacttgatgcaagattgggtaaaccttgtaacaagatattgcggaatttgatacacgtacataagtacgtgttggcttatgcttgcgtatatgtagcccgatgccaacgtatgttgcaagcttacgttactgatgttgttgaatatgtctttatgtttttagaaaacatcagcacctttttaaaaaaagataaccgccttttaaaaaaagacaagggcgttttaaaaaaaggtcagcatgtttcagcgtatatgcctatcatgttcagcgtacattactccatcactaagccgatattcttccttctccatttatcctttcatcttattaaaaacacacagtcaatcaagcggttaaaactggaaccgcttcccctcactcccgtttcaacggtaagcgtctccgcgattctatcttgtcgcccttttttcattcttatatttttgccatgtataaaaatgaagcattatggatttagcagaaaaggaggatgaaaggacaatgacgggatgttccttcatcaccggaacacccaccggcagggcgttttgacggtaaatgaaaggaggagggaaaaacgaattaaaacaaatgctgaagtgcggagcctataatttcagaatttctaacggaacccttcccaactgtgccgctatatttgagaatgaactctgaaaagaaccatagattttttgtgtgcgggccagcgtgtacatatctgcgacaccctccctgattccttccagagagccataatccgcctgtctttccgaggacaggctgaaataaaggtcggatcaacctttcttcttgccgaactccggatcaatttttagcagagccgttattccgaaggtgataacgcagcatatcataatccagataaagaaatggttgtatcccatctgctcctgaagccagccggcagccattcccggaatcatcatgcctaatgccataaatgcggtacaaatggcataatgtgctgttttatgttctccgtctgcaaaataaataaggtagagcatataggctgtgaaaccgaatccgtaaccgaattgctctataaagatgcaaatattgatgagatatagagaatcaggctggatatagctgagataaacatagactaaatcgggtaaggaaatggcccataccatcggccagagccattgtttcaaaccgttacgggctacggctattcctcctaaaatacctcctagggtaagtccgatgatgccgacagtgccttgtacgaaacctatttcttcggttgtcagccccaaaccacctttttcaacggggtctataaggaaaggaatgcacatttttgccagttgagcttcgggcaaacggtagagtaacatgaaaagaatggcaatgcctgcctgctttttttgaaagaaactggcaaaagtaccaaagaactttttgagcagattggaagcggaaacttctttggaggtatgatctgaatccggacagggaagaacaaacttatgataaatccatattccaaggaaaagtccggccaatacaaaaaaggtgatggaccaagcgtatggtatattatctgtcattatttccagtcttcctgcaagcatgataagtaatccttgtcccgcaatggttgcaatacggtagaaggtactgcggattcctacaaacagggcttgccgatgcgagtccagtgccagcatgtaaaagccgtcggcagcaatgtcgtgtgtggcggagctgaatgccagtaaccagaaaacggccaaagtgagttggaaaaaatgctctgtggggatggtgaaggctatgcccgccagtcctgcgccgattaaaagttgcatggtgataatccaccagcgtttcgtcttgataagatcaatgaaagggctccatagaggcttgataacccaaggcaggttgagccagccggtataaaaagctaactcggtattgctgatgcctaatcttttatacattatgaccgaaatggtcattactgccacatagggcagcccttgtgcaaagtatagagtgggtatccatgcccatggcgaggtatgcttgtttttcatggttcctttcattttaaagagtccgaatggaatccccgcccatgtgggcggggcctgttaataaaaacggcggatatccgcacctttatagtaatgcaatagaatttcatcgtaggtatatccccgttctcccattacggcagccccgatttggcagagccctactccatgtccccagccggcgccggtcagcagaaaccattcgggaacgccgtttttcagttctcccttatctattacaaaggctgagctgaacaggtgggaagaagatagagtgcggcgtatttccagttcctttccgatagtcaatgtttttagcgaacctacaattttcagtttgcagatacgtccggatttgccgcgttggataggaatcaggtcgatgatgtccccataatccgattttgtattttgacggatcagttcggataattctgcctgggaataacgtactttccaacgatagaaatctgtagtttcctgatcgtagttgttcagaatttgtgaaatgacttttttatcgtgggtatcacagaacgaaacaggagaagtacgtatccaacgctctgcctcttcttctttggtcagatcgggtaacgggcggttttcttcttcttccgcatcacggattgtagacaagtagggataattcttgtcttcccagcagtatccgaattcctcgcttgctcctccgcagcatttggagaaacgggcatcgcaaatgccgcgttcatacatcagcaattgtccgcgggtggctcttactgcttcggtcacggcggcactggatgctttggttattccttggtagcgttggcaatggtcatcggcgcaaacatcgaatatggtatgatcttcgcggtcgtaccagcggatgtattcggtatcggttttgataaaggagaaaaagccttcgtttttgtcactcaaggccttgcgtttctctatttgggcaaacagccagctgcgtgataccacggcatgggctttcagaaactccaaagaggaagtggcgttcatctccgaggagatgacgcttatcagatagtcttcggcgggaagaatattgatagcggtgattttgccttcgtccaccactagtttcagtgttcccataaaactttgggtttcttgccgttcccagtggaaattaattccgatggttacgtcatataatgaaaacgaggcatgttcgtcttgtggagtgaaggtcagttcgcggtaaagattaccattccacagaatacctccttcgctgaaggctacttgttgttcaccacagactgtttctcctttagcgaaaaaattgccgttcagtgaaaaatgaatttcttgtgcgtttactattcctacgcttatttcgggttctttcattgttattcgtcttgtttatgggcttgctgtaattccttcatctcttcgtgttctctctatctttttgctttctcgtcaaaataacgtccgggtatcttctcggcttcttctaccgttattcccacttcttttatgatggatgccactttttcttctgttattttgtcgaaatcttcctgacgggtggtgacgattacgccagccatgtccaaagctcccggactgatgagcatctgttcgctgccttttgcaaagtagcagtcgggacggtgcttgctgcggggaaaaaccaccgtatagtatagatggccttccttccataacagcaggttgaacttcgcttcttgtccgtcttcatccggtgggaaagcggcgagggcgctgtataacagggagtcgtcataatgcgtgttgcttgagaggattaccaaaggacagggatagtccttggtgttgaggtaaattcggctacattctagtggataatcttcctcttcttctaggtagggaaaatacatgctgcgtatatcgattgtctgtgcgtgggttatcagctgttgtacgttcgggatgatgggaacatcagtttttctgactccttgaagatggagatggtccggtgcagaggctccgcaatgtgctccattatagaatagggcgtagtccggatatttctgtacgaatgcacggacgtcatcgtaactgaaaatattctcatccatgagttgggggatgtgatctttatgggcgatagtgaggtgatccggcaatatgggataagggttaacgcatattctgtttgcagtgatggtttccagtgctttctgctccttaggctggttttccttgcacaggaaacaggggcgtgcttggatgctgtccttatccactttggcggtagtcgaaaccgcacgctgtgcattgcactgtaccacaaacgtgtagccgtttatggacagttccttggtctgtatagtctgtaatgcctcgtggttgtggtgtgccagtggccagcacgccagttggctgtctataaatcgcttgatttcattccggttcttcagctcttctgtatattttttgcggattcccagttcacgggtgcgcaggctgtctttgtagtgattgttggcattggtctgctctatgctcagggcggcatccgagttcccttcccagcggcggcacagatagagtacatcatagattcttcctatcttatattggcgcgagaaaatgagtcccagggcataatcttctccgtagctgacattgggcacgcctgtttcgcgcaggataggtgtgaagaatgcgcgcggagcccccagaccgttgatgcgcaatgcgttattgtgtccgttctctttcgtccactcgctatggtctatcactcccggagcgatggtgttcagccggaagtccgtcatgcggtaagttcctattaccatggcgcattgctctttgtagaacgtgtctacgatggtttgcagggtatgggtgtcgctgtacaggtcatcgctgtcaagctgtatggcgaagcgtccgcaccgggggtggttgattgcgaggtcccagcatccccctatgcccagatcggtacgttggggctgaaggtggattaccgctttgttgtccttgtattgaccgatgatttctgtggttccgtctgtcgagtgattgtccacgatgatgatgttgaatggaaagcgtgtttcttgtgcgagtgccgaccggatggcatcgtcaatggtacgggcgcgattgcgcacggggatgatgacggaggcttcatactcgaaatttcctttctttacatccgtttccacacatatgggttcaaggagggcattgatagatttcaagtatcgtgtgaatgcttcttccatttctatctgtacctctctgttacggggatttacgtagtcgaactgcttttcgccggacaggcggttgtcgctttctgtttccgtataaagatattcgttgatatgtaccagatgagaatggagggtaaggagcaggcgcagttcataaagggcggcatactctctttcctctgtcatttggaggctggcgaggatgaattccgttctgttgaatatcagtagcggaccgaaatcgaaatcatcacgcacactgccgggttggtagtcgttgacgggatgtttcttcttttctccgtttttccattcatgatggtcggcatagaccatgccgcattctctgtcctgcaggaagtccgtcatgcgttccagtgccttgtaagccagttccaaagcagaagtcttggtgtagagcaatatataaggtgtgtctgctttttcagcaatcatcttcattgtcttagaactggttagtgaatcaacaggtaatatttcgcatccttcgggggtggataatgtcttgttgggttcgatgttcagcagatagattttgttgactatgctactttcttttagagcatggattgtctgttctgccgctgtgctttccctataaggaataaagcaattaattgtttttctcattgttaaaaagtatttctcacggcaaagataggtaatatatcttattttttctctacctttgtacgctaattgtcttttaaatataaatggaaactccgaaaacagcattacttggcaggacattggatgagattcaacagattgtgaggaatctgggaatgcctaaatttgccgcaaagcagattacgtcttggttgtatgataaaaaggtggaaacgatagacgaaatgaccaatttgtcattaaagcatcgcgaagcattgaaagaagggtatgaggtgggagcatctgctccggtggaagaaatgcgttcggtagacggtacggtgaaatatcttttccgtacaccggctcataattttattgaagcggtttatatacccgatgaggaccgggctactctttgcgtttcctcgcaagtgggatgcaagatgaattgtaagttctgtatgaccgggaagcaaggttttacagctaatctgagtgcccatcaaatattaaaccagatctattctattcctgaaagggaaaagctgactaatcttgttttcatgggtatgggagagcctttcgacaatctggatgaggtgttgaaagtgcttgagattctgacttcagaatatggttacggttggagcccgaaacgcatcactgtttcttctgtgggtttaaagaaaggactggagcgctttctgaatgaaagtgattgtcatctggctatcagtatgcatactccgattccttcgcaacgaagggatttaatgcctgccgagaaagctttttccattacggaaattattgatatattgcataattatgattttagcaaacagcggcgtctgtcttttgagtatatcgtattcaaaggggtgaacgattcacttatttacgctaaagagattgtgaaacttttgcgcggcattgaatgtcgtgtcaatttgatccggtttcatgccattcctaatgtggatttggaaggggtagatatggaaacaatggttgccttccgtgattacttgacgcagcatggcgtatttgctacgatccgtgcttcaagaggagaagatatttttgctgcttgtggaatgttgtcaacggctaaacaacagaaggagaaaggtgttacattacagtaaataacaacaataataccatataattatgaaacgaatagcattttatttaagtttggtgctggtggttctggtactggcttcttgtaagaagggacaaaagaacttgtttacccccacgtccagcggtaggccttacgaagtattggtcgtagtaaataaacctgtatgggatcgtcctgcaggacgtgcattgtttgatgtattggataccaatgtgcccggactgccccaggcggaacgttcgtttcgtatatcaaatgtggaccctcagcattttgaccgtgtgctgaaaatattccgtaatatcatcattgtggatattcaagatatttatactcagcccaaactcaagttttcccgtgatgtttatgcgtctccgcagatgattatgacaattcaggcttttaatgaagacgaatttgaggaatttgtagcaaagaacagtaaagtgattatagatttctttgtgaaagctgagatgaatcgtcagataactttgttgaaacaaaaacatagcgatgtgatttccactaaggtaggaagtatttttgattgtgatatctgggtgccggtagaactggctaactataaagaaggcaaagattttttgtgggcttctactaatcgtgctacagcggatatgaattttgtaatgtactcttatccttatacggacaaggatacctttactaaagattatttcattcataaacgtgattctgtaatgaaagcaaatattccgggtgaacgcgaaggaatgtatatggcaacagactctatgtttgtagatgtggaagatattgttgtaaaaggagagtatgcgcaagaagcccgcggattatgggaaatggaaggtgacatgatgggaggtccgtttgtgtctcatgcacgggtggatcgtgctaacggccgtgtcgttgtggttgaggcctttatctattcaccggataaattgaaacgtaatctgatgcgtcagatggaagcttcactttatacattgagattgcccaatgaaagcttgattgacgaaattgtaattagtggtaatattccggaagaaaaaatagatacaacaagccgggtaaagtaagaagagacatataatatataatatagatggaagataactacaagatacgagttggtattactcatggggatatcaacggagtaggatatgaagtaattctcaaaactttttcggatcctaccatgctggaactttgtacacccattatttatggatcgcctaaagtggctgcttatcatcgtaaagcaatggatattcaaacaaatttcagtattgtcaattctgcagatgatgctcagccggataaactgagcatcgtgaattgtacggaagacgaattgaaggtggagctctccaaaccgacaccggaggctggtaaagcagctttggatgcgttggagagagctttgcaggattatcgggagggaatgattgatgttttggtaactgctcctatcaataagcataccattcagtcggaaagttttcatttccccggtcatacggaatatattgaagagcgtgtgggggaaggacagaaggcgttaatgattttgctgaagaatgatttccgggtagctttggtgactggtcatgttcctgtacgcgagatagcacaagatattaccaaggaacttattatggaaaaattggctgttttccatcgttctttaaaagaggattttggcatcgacagtccgcgtatagctgtgttttcattaaatcctcatgcgggtgatgagggattgattggtacggaagagagtgatattataattccggcaatgaaggaaatggttgccaaaggcattcagtgtttcggaccttatccggccgatggctttatgggatctggcaactatactcattttgatggaattctagctatgtatcatgatcagggattggctcctttcaaagctttggcaatggatgaaggagtgaattacactgcgggacttcccattgtacgtacttctccggcacatggtactgcgtatgatattgccgggcaaggggttgccttggaagattcttttcgccaggctatttatgtggctatggatgttttccgtaaccgtgttgtcgagaaagagattcatgcacatccgctgcgtaaacaatattatgaaaaacgggatgatagcgataaattgaaattggacaccattgatgatgaagattaatggacgatcggtttaaaatataatttcaagaaaaagtagaaatgaaatttgcaattatatcagcgggtgaaggttcccggctttcgcaagaaggggttgctttgcccaaacctttggtgcaactgaacggagttgccatgattgatcgcttgatacagatttttgtacgtaacggagctgataaggtggttgtcattattaataatgaaagtccattgacaaaagagcatttggcaaaactacaggcagaagcaaagatcccattggaagtagttgtgaaaactacccccagttccatgcacagtttttatgaactgagcccttatttgcaggatgataaattctgcttgactactgtggatactatattccgtgaagaagagttttcgacttttattgaaacgttcaaacaatcggaaacagatgggtatatggcggtaacggattttatagatgatgaaaaaccgctttatatatctacggacagtgctttggatataacaggtttccatgatgaggcgactcccgaatgccgttatatatctggaggcatttattgtctgaccccggcagccgttaagacgttgcatgggtgtatggagaaaggtatgtcacgtatgcgtaactttcaacgacagttggtagccgacggcttgaaattaaaggcttatccttttacaaaaattttggatgtagatcatgctggtgatatcgtgaaagctgagaattttctagccggtaaagaggagtaacttaaacacaacagaaggaatggatgtaatttcaataataggggtaagccgtggaaatgaatattcccccaatcatgtagacaatgatgccgccatattttataaggtgacggaggaattgcggcggttgggctgtgaggtgaaagtttatgcggagaaagatttcgtggaacagggtgtcaagggagatattatttttgatatggcccgtgataaggtaacgatagctcgtttgaggtctttggaggatgaaggtgcattggtgataaactctgcctacggtatagataattgtgtgcgtaagccaatgacagaattacttataaagaacggagttcctcatccgcaaagttttataatttctacggcagatgagtatttggaaaattgttatccttgttgggtgaaacgaggtgactctcacgctatggtgaaagaagatgttgcctacgccacctgtaaggaagaggtagaaaatatattggctgatttccgtaaacgcggtattcctgttgcagtcataaacgaacatttgcaaggtgacttggtaaaattctacggagtgcatggaaccgattttttttattggttttatccctctccttgttcgcacagcaagtttggtctggagaaaataaatgggatagctaaaggaactccttttagcgtagaggaattgaaaatacaaagtgataaagctgccgaggcgctgaatgtgcccatttacggaggtgattgtgtgatttcagctgatggcacactgcgaataatcgattttaacgactggcccagctttgcccgttgccgtgaggaagcgggaggtaaaattgcagagtgcatttataaacgggctaaaaagcaaatgaaataaaaaagacatgagtacagaaagtgagaagaaaggaatagaggcttctttcaaatccatggacacagaggagttcctggatatttatttcaaccgtcccataggttatgcatgggcattattttttaaaaaactaaaggtacaccctaatgtggtaaccattttttctatcattttaggtataggtgctggtgtgatgttttattatcctgatatgaaacatactcttttgggtatacttttgttgatgtgggcgaatcattatgacagtgcggatggacaattggcgcgtttgacaggacagaaaacccagtgggggcgtatgttggatggatttgccggtgatatttggttctttaccatttatgcggcaatttgtctcagactgatgaaccaacccatgccgtttcatattggtgacggcatgcattggggtatttttatttggatattggctattgtttcgggtactgtttgtcatagcaaacaatgtacattggcggattattatcgtaatattcatttatactttttaaaagggaaaagcggaagcgaattggataatttcaaacaacagcgtgaaatcttctacagtctgccgtggaagggaaacttctggtggaaagctttcttgtatttctatggtaattatacacgtcagcaggaaagaatgactcctaatttccaactgttttatgcattggtgaaggaaaagtatggagacaatattccacaggaattacgggatgaatttcgtgcggctagcaaacctttgatgaaatataccaatatcttgacttttaatacacgtgccattgctctatatatcagtttgttgattggcgaaccatggttgtattttgtgttcgaggttgttgtgatgacctctttgtttgtatatatgcgtcattgccatgaggcgatttgcgcacgattgtatcataaatacataacgaagtgaaaagtaagtatagaaatatattcctgatgtttggaattgcagccatcgtagtgatgctttgttcttttgatatggagtatgatgaactactggctaatttgcgccgggcgggaatgtggttgccggctgtggtagggttatggattattatttatctgttcaataccctttcttggtatattatcatccgggatggaaaaaagggaacacctattccattttggaaagtttataaactgacagtttccggatttgcactgaattatgccaccccggtgggattgatgggaggagagccttaccgcattatggagctgactccttatgttggggccagtaaggcaacttcatcagtaattctttatgtgatgatgcatattttctcgcatttttgtttttggtttttttctatctttttgtatctggctctacgtccggtagatattgccatgggaactatattggctgttgtgggggcggtttctcttttagccatttatttttttatgaaaggttacaagaatggtatggctgtccgtactttaaaattgcttcagcatattccttttatcaaagaatgggctaaacgtttttcggaaaataaacgcgaggctttggaacgtgtggacagtcagatagccgaactgcataaacagcgtagatctacgttttatgcctcgttaagtctggaattcatggctcggattataggatgtctggaagtgtatttcatattgaatattctgacaacggatgtcagttttccagcttgtattttaattatggcatttacttctttgtttgccaatttgttctttttctcgcctatgcaattgggcgcacgtgaaggaggctttgctttggcggtaggagggttggctattccgggagcttttggggtttataccggattgataacccgtgtacgtgaattgatttggattgtaattggtgtgttgttgatgaaagtcggcaatggtacacctgctaataagtaagataatggatacattgaaaaatattcagggagttatatttgattatggcggtacgatagatacgaacagctgtcattgggcggaagtgttgtggactaagtatatggaacatcaggtgccggtggataaggaaagtttccgtgaggcatacgtttttggagaaagggcgttggctaaatatccttttgtccagccttggcataattttcatgatgtgctttctatcaagactaaacttcaggtggaatggttggcggaacagagaaagttgcctatggatgagttgcaactgcaatcttatgcagtgaaagtggcagacagctgttatggctatgtgttggatatattgcaggttacacgcccggtagtgaaggagttggctaagaggtataggttggtgttggtttctaatttttatggcaatatacagactattttaaaggatttcggacttttggatttctttgatgagataattgaatcctctgtagtgggtgttcgtaagccggatcctgctatctatagacttggagtagatgctatgggatttgcggcagagaatgtgctggtggtcggagattctttctcaaaagatgttgttccggccaaagctgtaggttgtcgcgttgcctggttgaaaggagaaggttggggaggagaagttatagacgaatctgttcctgatgtaattattacggacttggctcaattgcttgcattattgtaataggatatggaaatacaaagacacgcattggtgaaaagggactatttagttccttttgttttagtaacctctttgttctttttatggggattcgcacatgctattcttgatgtattgaacaaacattttcaagaggtgatggatattacccgtactcattcggcaatggtacaggtgatgttttatctaggctatttcataatggctattccggcaggattgtttataaccaaatatggatatcgtaagggagttgttttcggattgttgctttatggaatcgggtccttgatgtttattcccggcgagtattggatgtcatttgaatttttcctgttctctttgtttgtcattgcttgcggtttggtctttttggaaacagctgcaaatccttatatgacagaactgggggatagggaaacagctgccagtcggttgaacctggcccagtcttttaatgggctaggatgtatttgtggtcctttagtaggaggactgttattgttctcggggaagggagaagcaaatatctcgtatccttatatgttgatgggagtggttgtactggcagtgggatttattttttcccgtatcaaacttccggagattgttcatgttgacgatttggctgacggagaaacggttaagagaagtttatggtcgcataaattattcttattcggaatagtggcactattcagttatgagatagcggagatttctattaatagtttttttatcaattatgtggtggatgacgggtggatgaatgctcgggatgcggcggtagtactttctttcggtggacttggattgtttatgtgcggacgttttgccggtagttggatcatgcagcgaatccgtgcggagagagttctgctatgctgtgctttggggacggtaatggctacttttcttatcgtttgtaatttaggaaagatttcattaatagccttgtttttggtatacgtgttcgaagccatcatgtttcccactatttttgccatatctttgaagggattgggtggaaagaccaaacgggcttcttccttccttatgatgtctcccgtaggaggggctgttggtcctgtgctgatgggttatgtggcagataatagtaccatgtccttatcattcatcataccatttgtttctttttgtattgtgttattctattcgtggtatgctgacgtggaaagaaactgaaatgaataatcccgatacagttgttaggctttatcgggattgtccatttcttcttaaattttttcagcttttaaagaactggttcggatgatattccatacatcctcttcggttttgctgaaaggaccggatgcctctagtttcagtgtcgacatagctgctgcaaaacaaccggcttcttcataggaagcccctttattacgcatatataaatatccggtagcataagtatctccacagccagtggcatctactatgtctttaggaggataggcagggattttatgaaatgtaccttccgcataaattatagaccctaagcttcccaatgtaatcaatacctcttttactccccattctgctagttgtagggcagcttgttttatatctgtctgaccggtaagcacttccatttcatgttcatttacctttagaatgtcaatatattttagtgcttctactttgtctgtccaatctatcggataaactttttcccctcggacttcacgtaagtacccttgtgcatctacagctaatatacctttggtagaaagatatttcacaacgtccaaagagaaatcatctgctaaaagacttcccaaatgaaaaatatgagcatttatgttctctagttgttctacggtgaagggatcggctttagccaatacccgctgactgcggttgtcttgattctcaccgtatgtattctcaaaatacactgtccggtgactaggaataacagtaactttgatgcctttagcacgaatatcttcaacagctttaaattcacttggagctagtgccgtgaccagctgataatgctttatatcctttaagtgactgattccgtgtgagaaataataagaagtcccgccgggcatataagtcgtttttctgggtgttactattttatctaatgtaatgtgacctatgcaacaaatatcattcatacctatttatattaaacggtcgcaaagctacaaaaaaaactagaaaaagcatggaagttttcaaaagaaggtgtaactttggcacaaattatcttaatctctgctatgagatgcaattttaacaaagaaattagaatggaaaaaatgaatgtgaaaccggcaaccggtaaattaggcgttctttgtgttggattgggcgctgttacttcaacttttatgacaggtgtgctgatggctcgtaagggattggcaaaacctgtcggatctatgactcaatatgataaaatgcgtgttggccgtggagagaataaaaagtatttgcattatggtgaaattgttccattggcaaacttaaatgacattgtgtttggtgcatgggatgtttatccggctaatgcttacgaatcagcagtcaatgctgaggttttaaaagagaaagatattaatcctgtaaaggatgaattggagaaaatagttccaatgaaagctgctttcgaccacaactatgctagtcgtctggatggtgataatgtgaaagattgcaagaatcgttgggatatgatggaacagttgcgtgaagatatccgcaattttaaagtggctaacaattgtgaccgtattgtcgttctttgggctgcttctacagagatttatgttcctgttgatgaaaaaatacacggaacattggcggcattggaacaggctatgaaagatgatgataaggctcatatcgctccgtctatgtgctatgcttatgctgcactgtcggaaggatgtcctttcattatgggagcacctaatacaactgttgatattcctgctatgtgggagttggctgaaaagactaaaatgcctattgccggcaaggatttcaagacgggtcaaacgttggttaaatcaggtttcgcaccgattattggaacccgttgtttaggcttggacggttggttctctacaaacattttaggtaatcgtgatggtttggtgttagatgagccggctaacttccacacgaaggaggtcagcaaattatctacactggaatctattcttgttccggaagatcagccggacttgtatacagactactatcataaagtacgtatcaattactatccgcctcgtaatgataataaagaaggttgggataatattgatatcttcggatggatggggtatccaatgcagattaagattaatttcctttgccgtgattcaattcttgctgctcctctgtgcttggaccttgtattgttgagtgacctggctgcacgtgcaggacgttttggtatccaacgtttcttgagtttcttcttgaagagtccgatgcatgattatactgaaaacgaaattcctgtcaatcacctcttccagcagtatgctattttgaaaaatgccattcgtgaaatgggtggttatgaggccgatcaagaaatcgactaatttataacaggattttttattcgggcgtggattgcgcgggttttcacggtttttcttttaaagaccgtatctatccgtgaaatccacgtcttattttttatttttctgccataatttcttgttgtctgcctgagaatttgtaattttgtcatataatagagtgaatatggttaggtcagaaatacaaaatgtaaagctcagatttggtattattggtaatgccgaagggttgaaccgtgccatagacgtggctatccaggtggcacccactgatttgtcagtgttgatcaccggtgaaagtggggtgggaaaggaaaatttcccacagattattcatcagttcagtcgccgtaaacatggacagtatatagcggtgaactgtggggctattcctgaaggtactatagattcagagcttttcggacatgaaaaaggtgcttttacgggcgctatcagtgaccgtaatggctattttgccgaagccaatggtggaaccatttttctggatgaagtaggagaattgcctcttgctactcaggcacgtctgttacgtgtacttgaaagtggtgaattcattaaggtaggttcatctaaagtgcagaaaacggatgtgcgtattgttgccgctaccaatgtgaatctgacggaagccattgccgaaggtcgttttcgtgaggatttgtattatcgtttgaacactgtacctattaaaatacctcctttgcgtgagcgtggagatgatataactttacttttccgtaaatttgcatcagattttgctgagaaatatcgtatgccggctatccagttgacagaagatgcgaaagttttgttgctggcttattcgtggcccggtaatgtgcgccagttgaaaaacatcactgaacagatatctattattgaaactaaccgggatataacggcagagattttgagaaattatttaccggaacaacatgtgaattctggtttgcctgctttgtttggagtgaaagcaaatacagggaaggcttttgaaagtgagcgtgagattttgtatcaggtgttgtttgatatgcggcgtgatgtgactgacttgaagaagttagtcaatacactgatggcggaacgtggcgcgcaatctgtcccgacggcaccagctactacggcagtttcttattatcaggaaccgcaacggaatctagttgctacagtggtgcctgctacgcctaccataatttctgccgccaaaccggctcatcctgtagtagatgatattcaggatacggaggaggttgtagaagaagccactttgtcattggacgaagtggagaaagaaatgatacgtaaggcgctcgaccgtcatcatggaaagcgtaagaatgcagcaaaagatttgaatatttcagaacgaacactttatagaaaaataaaagaatatggtttggattaaacaattgaaagtagttggtgtgttgatggtactggcggggatcgtaactgcttgttctatttcatataaatttaacggatcgtctatagattatacaaaggtaaagactatttcgtttgagaatttcccaaaccgttcagctggctttgtttggggaccgatggagaatatgttcaatacggcattacaggatatttatatgcaacaaactcgtttaaagcaagtcaagcgcagtggtgacctgcaattgtctggtgagataacgaattatgaggcatttaataaaggaattggatccgatggctattctagtatggtagaattgcgtatgacggtgagagtgaattttgtcaatagttccaatcctacggaaaatatgaacggacagcaattttcggctagtcgtgaatataattccaatcagcagttaagtgctgtgcaggatgagttggtaaaccaaatgattaaagaaattgtagagcaaatattcaatgctacagtggcaaactggtagtgagtgattttccgtcatgatacaacaacaattatatgaatggataacgcatcctgaacgattgaatcgggatactttgtacgagttgcggacgctgcttgcgcgttatccatattttcagacggtgagactgctttatctgaagaatctgtttttattgcatgacataacatttggtgaggaactacgtaaggctgcattgtatgtagctgaccgcaagattcttttttatctgatagagggggagtgctttactgtatcttcctttgaaaaacaagacctacctaaggaagaggctggtttggatcgtactctttcattgatcgatacttttctctcttctttgcctgaagagcccgttgttatggaattaccaatggatgtaacaacagattatacttcttttttattgcatgaggaagaacatgtgtctgatgatatacctcagatgaaaggacagaatttgatagacaacttcattgaaaagtcggcagaggaacctttgttacctcaattaggaataaaagaggcggcatcggtgaagaataaagtttctgaagaagaggagtcggaagataatgaagaggatatggaggatgaaagctatttcactgaaacattggctaaaatatacgttaaacagcaaagatattctaaggctcttgaaattattaaaaaattaaatttgaaatatccaaaaaaaaacgcttactttgcagaccaaataagatttttggagaaattgattattaacactaaatcaaaataaagaaaatgtatttattacttattggattaattgtgcttgcagctcttttgatgtgctttgtcgtactgattcagaactcaaaaggtggaggcttggcttctagttttgcttcttcaaatcaaataatgggtgttcgcaagactacagattttattgagaaattaacatgggggttagctgcttttatggtggcatgtagtgtgcttactgcttattttgttcctgccgctcatacagattcttctgtaatcatggaagaggcagtgaaagaaggagctactaatccgctgaatgcaccttcaggtttcgctgctccgcaaacaaatgacgctgcaacagaaactcctgctcccagtgattcggcacagtaattatagagaaaacattttccttaattaataaggataagcgtcctgtttcgtttacgaaaataggacgcttttttgttttaagttttttgctttgataagtatgcttttgtacttacttttgttctggaatgtttttaatctacaaataataaaagaatcatgttgaaattcatatcatggaatgtaaatggcttgcgagcctgttatgataaaggttttgttgatgttttccatcgtttagaggcagactttttctgcctgcaggaaacaaagatgcaggaagggcaactggatgccaagtttgaaggttatcactcctattggaattatgctgaaaagaaagggtattcaggcacagctatcttttctaaagtcaaaccgttatctgtgacatacggtttaggcatagaagagcatgatcacgaaggacgggtaatcactcttgaattggaatcgttttatttgattactgtgtatactcccaattcgcaggaagaattgcgacggttggattatagaatgaaatgggaagatgatttccgtgcctatctgaaaaaactggaagaaaagaaacctgtcattgtgtgtggtgacctgaacgtggcgcataaggaaatagacttgaagaatcctaagacaaaccgtaaaaatgcaggtttcactgatgaggaacgtgccaagtttaccactttgcttgagtccggttttacggatacgttccgctatttttatccagagcaggaaggaatctattcatggtggtcttatcgttttaaagcccgtgaaaagaattcaggttggcgtattgattattttctcacttccgattcactgaaagataggttgaaaggtgcacatatttatacggatatctttggctcagatcattgtccggtagaattgacaatagaactctaagaaacactctgaaaaagcttttgtttcaacacgaatctcagattatctataattaaaagataatctgaggtttgtgtcgttgaaagactctctctctgttttacttccgtaaattattgattcttgtttatctttactttgaaaaaacaaactataatgaaaagtacagatagagttaggtataattattattctattgattttgcttgcgtgtcaattgagtttattacaaaaagccagtgtatggatggaaagtggattgcgttcggccattcagaaggaagttcttatttttatagtagaggatatctcaagtatttgatggtggaataccgtttgttccctgtttttattataaagattagaatatgtgtacagattgtcaataccggaatctttgctaaactaaaagataagggatatttgaacacagctccggctgtcttataattgggagagggaataatctgtttattattgtatataccttcaaaaattgtttgtattaggactttcgtttgaagaaagagttggtctgctagatgtgtaattttgttctgtagaccgtgtggcgtataaaatttgtagaaaaatggggttaagataaggaagtaaagaggtatttgtggcgcaaatttcccgtttggatgattgcgccatgaataatatggtttacatagctacttcaatagccagtatctgtgtttcggaagtggcttcgatagtgacactttcaatgtcccatataccgataccgtcacggcgtgaaaggttttcgcctgctacattactctctccttctataacaaaaatgtaaacacctgtgcgaggtttgtgcatacggtatattacactatgtccggcatcaaatgtacctattgaaaaccaggtatcctgcaacagatgtgccggtgtgtttccggaaggagaaatgaaagttgccagttcgttacgtttcaataacgggcggatattataattatggtactcaggtttggtttcctctacattagggatcacccagatttgcaggaatttcagatcttcggttttactggcattgtattcactgtgatagatacctgttcctgtactcattacttgaatttctccgggggtgatggtactttcattttgtacattatctccgtgtcttaaatatccttgtaaaggaatggatactacttccatatttttatgcgggtgcatgccgaaaccttctccgggagccactgtatcgtcattcaatacgcgcaaagcaccgaagtgtatacgtctgggattataataatttgcgaagctgaatgtgtggtaagtttttagccatccatgattaaaataacctctcgtgttggctttgtcaataatcgtcttcataacttaatgtcttttctattggaatgttgttattgatataacaaattagaagttgaaaagtttggaacattgttgagtaatgaaaaaaacggggcggtgtaaaataaaagaagagatgatcaaatcatctcttctatagagcggaagacggggctcaaacccgcgaccctcagcttggaaggctaatgctctatcaactgagctacttccgcaattttttgtgggcaaagatggattcgaaccaccgaagtcgaaagacagcagatttacagtctgccccatttggccactctggtatttgcccattcgcttttaagagtctatctcaattctctcattgagtaggtttgtttctcaattgcgatgcaaaggtacggcttttttttgaatatgcaaattatgcaagaactttttttcaaaaaatctgcgttttttgcaatttctctttaaaatcgagcattttgatggcagttattgcacattcatcccctttatttcctaatctcccaccggcacggtcttctgcttgttgcatagtattggtagtaatcaaaccatagattacaggaatatctccttcggcattcagttgggcaataccttgagtggtaccggcacatacataatcaaagtgcggagtatcgccacgaactacgcagcctattgcaatcactgcatctacttttccactttttatcatttgtgcagaaccgaaagtcagttcaaaactgccgggtactgtttgtactaaaatatttttatcttttgcgccatgtttctttaaggtacttatggctccttccaatagggggccggtaatgttattgttccattcggatactacgataccgaaacgcatattttctgcattaggaactgaattgaaatcgtaatcagataagttatgatacgctgttgccattgttttttagttttagtggtttaataaaagaaagaggttatctgtacacaggtgcagacaacctctttatatcattaaggtatattcttttcttatttgatggatgcacgttcgatgtacttatcaatgtccattgactggtaagaattgaagtatttttctttcaccaaagtgtatgctttaacggcttcactattcttgcccaacttttcgaacaattgaccagcttggatcaaatagataggactcaatgcctggctgtctgctttatccgctgctttcagcaaagttcctgcagctttgtccaattgtcccatttcagcataacagttaccgatagttcccaaaatggcagggctcaccagctggtctttagcgctgaatttatccagatatttcactgcatcttcatatttacccaactgtgcatagcagatacctgcataagcattggccaaattaccagcagcggttccactgaattcatctgctactttcagaaaacccttgtaaccgatactgtcaccattcaatgcggtttcaaagttatcagctccgaaatattgttctcctttaaataaagcttctgatgcttttacttcattggggtcagaaataaaatgcttatatcccatgaaaccagctatgataatcactactgctgcaatagttccaaggattcttcctttgtacttgataaggaatgcttctgaggtactcagtgcttcttccatatctaatgggtcctgagtgtgtttttgttctgccatttttatatttacttttttattatttttcggatattctttttcggtcagcaaaagtagttcatttctatgtattaatgaaatttacgggcatatttttttagtttttcccgtttttatctctaattttgtatcctcaattaaatagaagttctatgatactgaaacgcatctcgatattgaattataaaaatctggagcaggcggaattggaattctcgccgaagatgaattgttttatcggacaaaacggtatggggaagacaaatttgctggatgcggtttattatctttctttttgtaagagtgccactaatcctattgattcgcaaaatatccgtcatgaaggagaattctttgtaattcagggtttctatgaaacagaccaaggtgagccggaagaggtatattgtggattgaaacgtcgtcagaaaaagcaattcaagcggaataaaaaggaatataaccgtttatcggatcatattggctttattccccttgtaatggtgtctcctgctgatgcggagctgattgcaggaggtagtgacgggcgccgtcgttttatggatgtggtgatatcgcaatatgataaggaatatttggatgcgctgatacgttataataaagcattgacgcagcgtaatgctttgttgaaatcggaacaggaattcgatgaggaattaatgctggtatgggaggagatgatggcatctgcgggtgaggtcgtctttaagaagcgtagtgagtttattgctgagtttatacctactttccagtctttttattcttatatctctcaagataaagagaaagtgaatctggcgtatgaatctcatgctatgagtgggggattgctggatattatcaaggagagccgtcggcgcgaccgtgtaatgggatattcgttgaagggagttcataaagatgacttgattatgcagttgggggattttccgataaagcgggaggggtcacaaggacaaaacaaaacttatcttatcgccttgaaattagctcagtttgactttttgaagaaaacgggcggcaatactactcctttattgttgttggatgatatttttgataaactggatgcttttcgtgtggaacagattgtaaaactggtagccggagatcgtttcgggcagattttcattacggataccaatcgggatcatttggataaaatattgaagaagatagaaagagaatacaaagtctttgctgtagaagatggagaagtgacagaaagaaaggaaatggctgaatgaaacgtaatgatgcggaacaaataggggaaatgattcggaaattcttccggcagaatgctttggaggcgccactgaacgagtatcgtctgatacaggcatggaaagatgtggtgggacctgccattactaaatatacgagtaatctttatattaagaatcaaattctttatgtacatctcacttcgtccgtgcttcgtcaggagttgatgatggggcgtgatttattggtgaaaaatctgaataagcaggtcggcgcacaagtgatagtcaatattattttccgttgactggatggtcttctgctgtttctttggtatccccgaagtttcctgcaatacttcctgtcaggtgcggattttgacggatttttcttatctttctcataaagcccgcacttgaagaagtgtaatgtgtaagagtagcttatggaacagtccgtatcacgatagattctatttcaatattccattctcagtccagacttcatccattctccggtcgaaaggttcgacaggcagcttttcgtttacttgaaagttataacatatacctatattataggaatgaagaagaggcagtaatttgtcataatatccttttcctcttcccaaccggttgcctcgggcatcaaaagaaacacccggtataatggcgaagtctatcttctcatacgctgtaaatgcttctcccgtcggttcctctatgtgataagcctcaccggttttcaggttttgcctgcctgtataaatacgaagttccaactcatctcctttgactaccggcagcaaaactgttttctgccggtgccatttttcaacgaagtcatgtgtctgtacttcatcatccaatgaataatagagcaaaacggtacgggccgatgcaaacttgggatgctgttccagtttctcaagcaaagcagcggacttcgttattaattcggtgatgccgtgacggcgcttttcttgcgctatctgcttgcgcagttgtttttttagttccttcatcgcttactttcggttctatgggttgttcgggagctttgggaaatgattcacctttatccaatacttccaatgctttgaggacagtcttgtcgctcttgttcaagtattctatataagcttccatgcccagcatgttataaatgatgtttccgtataaatttgtttcaaacagtttctgtgatttatacatcaatatgttgcgacgttttagccctttgttctcagcgaaacgggcgaattgttccaaaatattctgatgcttcaaatattgcagcaggctttcctctgtttcatatttttgcatttcggcacggtggttgtccgtatactggaaagcaaactggatggtcagtccgcgattaacagccatgcgataataggaagtcatgccggtagtatcctgtggtacaaagatatcgggcataatacctccacctccatatacaggacggcctaaagaagtttcaaagatttggctttgatcctgcttgatactgtcttgtgagaaaaattctccgtgttcgtaacgggtcaggatatccatttcataatttgcgtcattaccttttacatacggtttctgtatgcagcgtcctgacggagtatagtaacgggcaattgtcagacggatggctgaaccatcgctgaagtcgataggttgttgtaccagcccttttccgaaagagcggcgcccgatgattgtcccccggtcattgtcttggatagctccggcaaaaatttcgctggcagaagccgaaccttcgtccatcaatacgacaatgggcattttctggctgcttccggttccgttggatgtatagttctcgcgtggagacttgcgtccctgtgtataaacgatgagtctgtttttgggtaagaattcgtttaccatctgaattgctgcacccatatatccaccggtgttaccgcgtaagtcgatgaccactccttcgcagtttgcctgatttagcttggctaatgaaatcaataattcgggataagtcgtttcaccgaatttgtttacttttatgtaaccgaatttgtcattcagcatataggcggcatctacactctttaccggtatgtcaccacgaacaatggtgaaatgtaaagtttctttttctcccggacgaaaaacgccaagttttacctcactgcctttgggacctttcagtcttttcatggattcatagttggtgacaatttttcctacaaaggcactgtcatccacttctatgatgcggtctcctgccatcagacccactttttctgatggtccgccttggatgacattgtttacatggatggtatcttgctggatggtaaactggataccgattccgctgaaacttccttttaaatcagaatttacagcttccaggtcttttgccggaatataagaagagtgggggtccagctcacctagaatttgcggcatagcatcttccaccagttcacccatgttcactgtatctacatattggtcgtcaatgatacgcaacaatgcattcagtttgttggatgaagtattaatgatacctaatttgtttcctgaaaagtggttggcgtaaaaagttccaatcaatattccggttacgatgcttactgcaacgattaccggcataaaacgggatgttcgatttttgctcatatctttatttgctattattcattgggattgatatagattacttcaatatttgcgcgtttcaataaatcaagcccgtcttccaaacggtatttttctgagtaaactacacgtttgattcctgcttggatgatgagtttggcacattctatgcaaggagatgcggtgacgtacatggttgctccgtcgctgctgttgttgcttcgtgctattttggtgatagcattcgcttcggcgtgtagtacgtaaggcttggtgactccgttgtcatcttcgcatacattttcgaatcctgcaggagttccgttatatccgtcggagatgatcatcttgtcttttacgatcaatgctcctacttgacggcgttcacagtatgaattttccgcccaaatactagccatgcggatgtatcgtttgtcgagtttgagttgtttctcttctttcgtttccattatttcagtcttgcttattatgtgcaaattgaatataagtttttttcccttcgggagctagcaataaaacattgctgtcaccttgataaaatattgcattattcaatgcttctatgaactcgttgttatagcttgttgaaggcggagtcttggtaaagtttatgtttactgtccggtcttttccgtccgcttgccatgtgccttcaatggttccattttgtatgcttcctgtaaaagtaccatccgctttgaaagtgatgttgaaaccatgaatgatatccaaggcttttcttccttcggttgcgatagtcttatccggattgtgtgccattgcattgtatttgggctctccgttccgtttgtcccaatttgctttaccatagaaatccactacatgccatgtgccgcttgcaaagatttcctctacatcgtcttcattgttgcaactccataagaaagggagtagcattagtatataaagaatagactttagtttcatattgtttggttttttagttgatgattccatttcttttcagcaaggcatggatactgggttcttgtccacggaagcgtttgtaaagggtcatcggatgttccgttcctcctttcgagagaatattctcccgaaaagaagcggcgacttcctggttgaagattcctttttccttgaataaggagaaggcatccgcatccagtacttccgcccatttataactgtagtatccggcagaatatccccccgccataatatgtgagaactgtacggacatgcaggtgtcttccactccgggcagtacttgcgcttttttccatgcttctttttcataagcgcggacatctccgtcaaatgtttcccggcgggtgtaccatgccatatccagcaagccgaaacttacttgacgcaggcaggcataggccacattgaaattggatgcatctacaatcttttggatcagttcggcaggaatgggttctcccgtctgataatgtctggcgaatgtattgagaaattctttttctgtggcgaaattttccataatttgtgatggaagctccacaaaatcccaatatacgctggtaccactcatggttgaataggtggtattggcaaacattccgtgcaaggcgtgtccgaattcgtgtagaaaagtgtttacttctgagaaagtcagcaatgccggtttcccagccgatggcttggtgaagttcatggtaacggatacgtggggacggctgttgactccgttttctatccactgctccttatagctggtcatccatgcgcccgaacgttttccggcacgggggtggaaatctgtataaagtacagccaggaaacttccgtctttgtcgaatacttcataagcttttacatcgggatgatagaccgggatttctttattttctttaaatgtgatgccatacagacgggtagccagaccgaatacacctttctctacttggctcagctcaaaataaggacgcagctcttcttcattcagattgaatttcttatttttcagcttttctgaataataggcccaatcccatggcatcagctggaagtcattgccttccatttcgcgtgccaatgcttcaacttctgccacttcctttagggcggcaggggtataggcatccagtaattggttgagcagtttgtatacggcatcactcgtttcggccatgcgctttttcagtttatactcggcaaaagtggagaagcctagtaaatgagccagttccatgcgaatgtttaccaattgcttgatgatgtccacattgttgtattcgttattgtgtgtacattgggtattataagccatatagacttctctgcgcagtgaacggtcatcacaatatttcatgaaaggaacaaaactgggagcatccaatgtaatgatgctgccttcttttcccttatcctttgctgtttgagcataactttccaatgaactttcgggtaatccttccaattgtttttccgtcaaagccaattcgtagttatttgtttctttcaacagattctgagaaaaacgtaaggtcaatatgcttaattcggtattcagttggcggaacttttcttttgcctcaccggtcaggttggcaccgcttcttacaaaaccatcgtatgtcttttgcagcagttgggcgtcttcacctttcagttgtaactggtctttttgttcgtatacggcttttatacgagcaaaaagtttttcattcagactgatgttgttgctgtgttcggacagtacgggcatcattttttctgccaattcctgcatctcgtcactggtctcggcactcatcaaattgccgaaaacagtagttacgcggtctagcaacgcacctgatttttccaaagcaacaatggtattttggaaagtcggtgcttcgggattattgacaattgcatcaatttcctcattttgttctttcattccttccaacaaggcaggttcataatgttctatcttgataagatggaacggagccgtgtcatgaggggtgttatagggttttaaaaatggatttttattttcagtcatagcactattttatttgacttacaaatttgctaaaaaaaagcatcactatcctcattctatttacttatttaacaaagtatattaaatagttaggttaaaaataaaaaagcacaagcagaaatgcctatgcttttcatttttatggttttttacctgattatttattcttttcagtcagtttttccaacgccggaatggagatttcctttctgctgagttgtaccaatccctgttcctgtaaatcattcagcacttttgacacattgattcgtgtctcatcaatcaaactcgccaaatcctccattttgattttaaggatttttttcccttcgggcttcatggagcgcagcactaaaaaattcagtattttttcttctgtattacctatgtggctgttccataatttttcgtatgccacttgtgctctattactcagaatatttaaatagttaaggcggaagatttcgtagttgttcagttcattcaatacaaataacttgtctatggtaactatgttaatatctgtacgtgctttgtaagtcgctgtatagttggtttgcatgccgaataatgaatagggctctataacgaaaggacttccaaaagtttcaaataaggcgtatgaatgtcggttatcggttgtttgggagattatctccccatttaagagaaagattaattgagtgcaaggtgcaccttgttccacaatgatatcatcggcgttgtatttacgaaaatgtagctttaccttgcctatgatattggtgaagtcatttttacataatccctggaagagagggagttgtaaaagtgtatcatacattgtaatttccataagttctgttgttcgttaagttatagtttaacatacaaaggtaacgataaaacgagatttattatttataggtggaagaacttttattttttttattgtttcttaccgtctcctaatgtttaaaagcagaatacttgcggactgtataaaaaataaatatatttgcattcaaaaaaaggaggagtttatgtttggatcatttgattttcaagaatttttaagtgcgtttattgtgctttttgctgtcattgatattatcggatctattcctattatattgaatcttaagcagaaagggagaaatgtcaatgctaataaagctaccggcatttcttttgctttattgataggtttcttttatgcaggggatatgatgctgaagttatttcaagttgatattgcttcgtttgccgtggcgggtgcttttgttatttttctcatgtctttggaaatgattctggatatcgagatattcaagaatcaaggtcctatcaaggaagcgactttagtccccttggtttttccgttattggctggtgcgggagcgtttactacgttgctttccctacgttcggagtatgctcctgtaaatattgttgtagccttgatattgaatatggtttgggtttatgtggtgctgaagttgacagatcgcatcgaacgtttcttgggtaaaggtggaatttatgttattcgtaagttttttggaatcattttgttggcaatatcagcgcgtttatttactgctaatctgactttattgatagagcagtttcagaaagctcagtaatatgctgtttttttgcagataataatgtcggaactcaccatagatattttattggaaaccaactgctttgtgttgaatggatattaatctgtggtgagttccggtatcattccatttgaatggtagctgtttgatattttgatacgctcctttggtgtctatttctcgttgatgatgaatttcttcattccgtctgtaaaataagtttcatatttatctccttcgcctgagcaaataaaataagcatccagttcaggatgtgcttcacaaaatgctttggctgagtccagtcccatcaccatgaaagcagtggcgtatgcatcggcactggcgcaatcttttgcaatgacagtggaggacaggatactatgttgtactggatatccggtgcgtgggtctatggtatgtgcatatttctttccacctttgtaatagaaattacgataattccctgatgttgccatgcctacgtcactaatggcaagcacagtctgtaattcctggtttactgacaaggagtcatctacaggtttgtttatgccgatacgccaagcgttcattttggaatttttgcctcttaccactacttcaccgcctatatctaccatatagttttttatccctttacgttccaatagccttgctactgcatctactccgaatcccttggctatagcgctgcaatccagcattatacgagggtcttttttcataatccggttgttctgtaaatctattttttgatatcctatcatttggcgtaagctgtccactatcagtgaatccactcctgtagattttttgaatccgaatccccatgcatttaccaaaggtgcgacggtgatatcaaaggctccatgggtttcatcggatattttctttgagagatggaatacatgtacgaaaaaactgtcaacttccgtcttttcattgtggtttacgcgggtgattacggaattcggattgaaaggagagagggagttgtccactttcttcagttcagtttctatttcttctttcagattatcttcggactggtaggtgattttgtatactgtaccgaatacaaagccttcatccgtacggaaaggggcttgcttttttagaataataattgttcctattatcagaattgctagaaacggcaattgccatgctaatttttttttattcatatctgtattttagttaagaaagaaataaatgttctattaaaattttaacgccgataataatcaaaaccaaacctccccataattccatgcgcaggttgaaacgcttgccgcaaaatacacctatcagacttcctaatgttgagataacaaaagaggtaaagccgatgatgacaataggagaaagaatagaagtgaaagagtttattcctacaaaagcaaatgatataccgatggccaaagcatcaatgctggttgctatagccagcgtaacaaccacttttaatttagtggggtcgaagcagcgtttgtcttcattgctgaagctctcttttatcatacgccctcccaaaaaggccaataacccaaaagcgatccaatggtcataattctctatcaggtgactgaatcggctggcggcaaaccagccgataagcggcatgacagcctggaaaaggccgaagaagaatgccataataaaaaaagtgcgccagcaaatgcgacgcatgataattccgcttgttatggaaactgtgaaacagtccatagcaagactgatggcaaggagccatatttctaaagttgtcattggttaaaatggtaatttgtatattaaactgtatgttactcctaagttagtcgagttgttttttccaaaaccgggaatataccaaggttcggtgtgttccgccttttttatgttcatgcgtatacggtaacgtagtgaccatcccatgtagaaattcttgtacacatttacctttattccagccagcagttctgcccaggttactgtggtcttaattccgtcataactgaaaggaatttcaggaaatccccatgtaggatccttcattgtcggagcatctacatcgtatgaaaaagaggtgaatccgtaacgtatgcctccatatagaaaaccaggcagatagggcttcttgaaaaagaagttgtagttcatgcctatacggaaataaggagctgaggctttataatgtatattggtaccgtcatcagtagtgtcggtggttccatatccaatttcagctacggggacataacggtttttcaaattgacctccacgctgatttctgtacttgtaatgtcacctccaaaaattttgcttcccaggccaaatatatctacaccgatagtagttccctgatagaagggtaccttttcttcctctatggttgtttttttttcttgtgccgccagtgtggggctgtacaacagcatactactcagtagcgttaacaacgtaatatatgttgaaattctttttttcttcattattgatgtccgaatttacaatctcgatagattttaggttataggtggtgtatttaatgtcttccactttataaaacatcatggtgccacattctatattctgcaagtaggggatattttggtgaatgagtgtgatagtgtcacgcatcttttccgtataatgcaatacgtaggtagtttttgatgtataactcaaaggcaggctcatactgctttccgctttattgaatatcgtgtcattcatcaatgagtcttttactacggtttccttaatagttccatcttccagtgtgtcacgtacaatcacatcggtagtgataaatccagtgacgtcaaaagccggactgaattttacagcttggtgtgtctctgcatccagaaagtcgaaatgggcaaaggaattggtggtaagcggacaatcgctttccccacagctttgcatcaaggtgcttacggtaatcaggagcaataagataatggctggtagtttcttcattttaaaactctttctctattttataattattgcgttcaggagcattccgggctatcaattctcctatgaatccagccagaaacagttgggttcccaaaatcatcaaagttagggccagatagaagtaaggagaatcagtaattaatatataaggtaaaccatgtgacaaggcatatagtttgttcgctccgatgataatgacggaaatgaaaccaagaataaacatcaatgatcccataaacccgaagaagtgcatcggcttgataccgaatttggataaaaaccacagagtaatgaggtctagataaccattgaagaaacggtttaatccgccgaattttgttttaccgaattttcgtgcctgatggtgtactaccttctcggctatcttaggaaaacctgcattctttgccagataggggatatagcggtgcatttcaccgtatacttcgatgttctttacgacatcacgacgataagcttttagtccgcaattgaagtcgtgcaggttcttgatgcctgaaacggcacgtgctgtggcgttgaatagtttggtcggaatggtttttgataacgggtcgtagcgtttttgcttgtatcccgatactaagtcgtagccatcttctgtaatcattctgtataattccggtatttcgtccgggctgtcctgcaagtcggcatccattgtaatcaccacatcaccttgcgccttttcaaaaccacaatacaaggcaggggacttgccgtagttccggcggaatttgataccttttacgttgtccgactccgagcgtagtttctctatcacttgccaggagtggtcggtgctgccgtcattgacaaaaattacttcatagctgaagtggttggcatccattacacgttgaatccatgcgaatagttccggcaaagattcttcttcgttatacaaaggaataactacagatatatccatcttttattcatttttctttttacgcatcacgatcaatgccgtagggatagccattagcatcccgtaaaacatattttgtgatatcagttgaaatgtcatttccagcggggtaagtcccgacagtaaatctatcgcttcttcgaattggttcagtgaggttgtcagttcggctccggcagtttctttgaactgatttaagatggaacggtatgcctcgaatacgaatccaccgtctatatagcggaagtagatgtagtgaactaccgcaacaaacagagaggcgaacatatacataaaggtagtgaatagaaacgcacgtgaaaaagtgatgcttccgtcacaatgccgttctctgaactttttggcaaatatgtatcctaaaaagggtactcctatagtcaggactataaaaagtaattgtaggaaaggtattctcaatcctaacgggaagagcatgaatttgaaggcccataaaagacccatgcccgtaccatagcgcatggcgcattcctgcaaagtcggtttataattcgtcattctttattaataagtgcacaaaagtacttcttttacgggaatccgtcctatagttatgggtgaaaaatgtattttttctgctaaaatcaaaaaaaagtattcgaaagtattgtagttttgaaaataatgtctacctttgcactcgcaaaacaaaaatgggtaagtcctatacggccagctcctgatgaatcctccagggcttgatcgcagcaaaggtagttggttgtagcggcgcgatatagtaagcttacccacccccgcctctttagctcagttggccagagcacgtgatttgtaatctcggggtcgttggttcgaatccgacaagaggctcggaaaagcgagaaggacgaagaaatcttcattcttctcgcttttttttattatatttgcgttgatattagttttaaggttggtacaaccgttatttaagagttcttttttatgatagagtcacagattgtggcaagagtattgccgtctaaatgccgtgaagcggtaaaagtccttttgcaggaagtgtacggatatgaagatttccgtaatttagaagtttatgatgacttgttcagaggtaaggaaaaattgcaattgtctcaaggacaattaattgaggaggtcattatggaagccgaaaaagggatcaagggtgactcgtctgctcataatttgctcctgacagctccgaccggagccggaaaatcattgttgtttcagctccctgctatttatctgggtaatgaatataagcttcttactcttgtggtttctccgctgaaagcattgatagtggaccaggttgaggcgttgcgggaactagggtatgaacgtgtggcgtatgcttcgtccgatctttcacctgaacaaaagaacgaagtatatcgtcgtgtccgtgaaggggaggttgatcttttttatctttcccctgaattattgttggcgtatgatatcagttattttgtaggtgaacgccgtatcggactggtagtggttgacgaggctcataccgtgaccacttggggtaaagagttccgggtggattattggtttctagggcgtcatttggaagctttaaagaatgcgttggggtatgtattccctgtttttgcattgacggccactgctgtgtggaatcccgaaggcgggaacgatatgatttttgataccatccggtcgttgcatcttgctccgtgtgccttgtatgtgggcacggtgaagcgtgaaaatatcggctttgacattaccgccatgaccatagaggagggggaaacctacgataaggccaagcaacgtactgttgccgcccgggtggaggattttctggacgggcataagactatcatttattatccttttgccggaggtatagatatgaaactgaagacctgggtgtatccggctaactggcattgggtggcatcttattatggtaaaaaggataaagagcaaaaagccgaaattatacaagcttttaaggagggtgagaaaaaaataatcgttgctacgaaagctttcggtatgggggtggatatcagcgatattgaccgtgtatatcatgtggctccatccagcacctttgtcgattatattcaggagattggccgtgctgcccgtgataagaacattacgggtgtggcggtgacggattttaatgagcgcgacttttattatatgaaacgcctgcattctgcgggtgccatctcccaggaacagttggggatgattctgaagaaagtttgggaaatatatctgatgaaaggctgtagtgatgaaatgcagatgtctttatccgattttgaatttgcagtgaagttgcctcgtaaaaagaacaagctggaatatgaatcggatttggagcaagtcgtcaaaacggctttgttatggatagaagaggatttgagtttccggcatggcggttctcctgttgaaatcaattcacagacgttgttttccgatggctatgtgcaggaaaagacgggtgatgccgctttccgtaaaaaatacaagcagtacatggttcccgtgaaaggggttgaaggagtctataaggtggcttttgaatctttgtgggagaattgtttctcggagatgggataccgtgagtttaagcgcgatttatacaatggaaatctctttgagggagttcgtgcggcagctgtgggtaagcatgatgtcttgttaaaagagagtgcggcggatatctgctccaagctggcaagtctcttgaagagtttgaaagatttgttgacggtgagtctgtatggtaataaaggaaagttcgaggaggacgatttgcgtagtatttttgcggcgtatgatatggatgttccttctgccaagcgttttatcacttcgttactggagtccagggtagaggagggcagaagtgtgagttacatcaccagtgccaagaagaaagatgaagacaaactgatgtttaccgttacccgtggttttgatttgttgctttcccgttaccagaagttgtgtgcccagcgtatcacaggaaagaaaggagaccggctgttgttctatgtcactccgttctccgatctcaatatgttgctcaacttgttgtctatgctcaatgtggtggactttaccgtagaggggggtgttccttctgttggagtacgtgtccgtgatgcagagatattgaaaaaggaagctgcttcgggggactatcagaaccatgtgctggagaataatgagaaaatattccaggaacagatagagttgttccggctgttctttggcaatacaaaactgagcgatgagcagcgatgggagtttatagaggattattttacggggatgagtttggagggattgaaagaaaaatattcttgtgttgtggaatgacagctgtaagggctgtataatataactcgttggcgaaattaattttgccttgtatgatttcacgttagtatatgaggttgtgccaacgttttgacacaacctctacttgatagccgacagtatgggcattaaattcacttgaaatgaatttgttttccaacttttattgttaatgcgaagagaacgactttgacgaatgctactctttatttggctggtacgcgcaaagtcacggaagttggaatcagcctcttgtcggcaaccatgacggtggaggaacgggaagacaatgttgtgataattgatcatcgtttttgtttttaaagggttgttattatcagaaaagtgtcaggaaggaacaaggcgcacactgctgcggcgtccggtgaaacttggtacaagatccgcggaatcttgtaccaggatttttgtaatcttgtgccggggtgcggctggttccttctgacactgcaaagataacttcacgtccgtgcggcgtgaccccttccgaccccttttgaccccttggcggattgcggggggaatcatggctctccaagtggaggcagactggttgcaactggcagcggggacacggggacagtggggacagcccctttttttctcacacacacgtgcgcgcgtataaagccggggtcagctcttgtgatacgttccccctaccgtccacactcatcggaccccttgcttggtgaaccgtttgggccgccttttcctggtggtaggttttcatcgcctttttcacctcggtgcgtatacgaaggtctgcatgcagggggcctcccaggagcagtgtgttgtgttatttggtttttttactgtaagagatgattttctctagcagctccggccatatgtcatcctgtggaaaggcaggcagggggaaataaggttcggagccttcggtgagttgttcttcctctttggtgtcattgggaaactcattttccaccttattgtatcgcgcgcacgtgtgtgagaaaaaaaggggctgtccctgctgtccccactgtccctgccttgtaagaatcggcggaactgaataacggaaaatatttttcaggaggacttgtctttaaaattcacttgaaatgaatttgttttcccacttttattgttaatgcgaagagaagtcgttatcttcgcattaacaatccatttaagaaaaagagaatgatgaaatatcccattggcatacagagttttgatcaaataatagaaggtaattgggtctatgtggataagaccgatttggtttatcgtttggtaacgacgaccaaaacttgttttcttagccgtccccgtcgttttgggaagagcttgttggtaagcacgttggatgcctatttcaaggggcgcaaggaactttttgacggcttgatgatagcgaagttggagaaagactggcatcagtatcctgtgttcaagatagatttcaacggtgttaactttacggaaaaaggaaacttggaagctaccatagaatattatcttgccaactgggagaaaatctacggagaaactccccgtgaggttcctatggggaagcggttcgaacaaatactttctctagcctatcagcaaacggggcgtcgtgccgtggtgctggtagatgaatatgacaagcctattctcgatgcattggatactcctctggaagatgccaaccgcgaaatcttgaaagctttctattccaccttcaaaggggctgatgaatacttgaggtttgtgttgcttacgggagtgacaaaattttcgcaagtcagtgtgttcagcgggttcaaccagcctaaagatataagtatggataatcattatgaagcattgtgtggtgtgactcaggtggaattggaacattattttgcagaacctattgcaaatttggctgaaaagttcaattatacagtggaggaaatgaaagacgtactcaaaatgcaatacgatggctatcattttggcagcggcttgcttggtgtctataatcctttcagcctgctcaatgcttttgatatgaacgatatccgcgactattggtttgcatcaggtactcctacttatttgatcaaacttctgcggcataaccacgagcagatggatgaattgactgggcgttactatgatccttcgatgtttgtcgattataaggccgatgtggaaaaaccgctgcctatgatttatcaaagcggctatctgacgatcaaggaatacgactcccggagaaaccgttacctgttggactttccaaataatgaggtgaaaaagggatttctgaccatggtggcagccaattatttcaaaccccaagagtttgaagtttccaactggattgtagatgccgtcattttacttgaggaaggggaaactacggctttttgttcagctttaacttctttccttgcggatataccttatgattctcatggctcgataaagacggttgaagcgacagaaaaacattttcaatatactttctatctgattctccgtttgcttggggtatattgccagttgcatgtggagaaaactcagtcaagaggaagagtggactgtgtattggagacaaaggattatgtatatatatttgagtttaaactggatggtacggctgctgaagccttgcagcagatagaggacaaaggatatgctacaccttatcagacagacacgcgcaaagtcacggctattggtgtcagtttttcatcggaaaccatgacggtggaggaatgggaggaaaaaacgttgtagcccagttgagattaaataatagtgcaaaagtaatgcctcaagccggaatcatcacgatccctcttgaggcagtcttcatttatggaattggggatataaaccgcttacgctttaaaattgcgtgctatttttttatatccatatacggcacggttacccaattcttcttcaatgcggagcaactggttgtattttgccatacggtcgctacggctcagtgaaccggttttaatctgtccgctattggtggctactgcgatatctgcaatggtagcatcttccgtttcaccggagcggtggctggtcacagtggtgtagccgttacgttgggccatttcgatagcatccagagtttcagtcagcgaaccgatctggtttacttttaccaggatagagtttgcacaaccttcactgattcctttttccaggaacttcacattggtaacgaacaagtcatcacctaccagctggcaacggttgcccagacgctcggtcagcatgcgccatccttcccagtcgttttctgccataccatcctctatcgaatcaatggggtagtcccaactcaatttttccagataggcaacctgttcggcggcactgcgcttttcccctttggggccttcaaacttggtatagtcatagatgccgtcatgataaaattcggaagaagcacaatccagaccgatggtgatatgtttaaacggttcatatccggcagcttcaatagcggcaaggatacagttcaaagcatcttcagtgccatccagtgcaggggcaaaaccgccttcatctcctacggctgtgcttagtccgcgttttttcagcacctctttcaaagcatggaatacttctgcgcccatccgtaaggcctcacggaatgtctttgcgccgacaggacgaatcatgaattcttgaaaagcgataggagcgtcgctatgcgagcctccgttaatgatgttcatcatcgggacgggcatgacataggtatttgttccgccgatgtatctgtaaagagggatatccagatagttggcggcagcttttgccacagccagggatacgcccaaaatagcatttgcgcccagttttgatttagttggggttccatccagatcaagcatggctttgtcaatgccacgttggtccatagagtccattcctttcaatgccggagcgataagggtatttatattttctacagcttttaatacgcctttgcccccgtaacgggtcttgtcaccgtcacgtagctccaatgcctcatgttcaccggttgacgcacccgatgggacagaggcacggcccataatccctgattccaatatcacatccacttccacagtggggttaccacgtgaatccaaaatctctcttcctttaatctctgctattttcatataattctaattttataagatggttttattttaataacaatagagaagccggatttgttgaggtgccagggaaagttttttcatgatatttacttttttatttctttccacagagtacatccgtcttcttttttcgtctccctttaataaaagctagagatcaatatgaaaataaaatggatagtgggggggctgttatgggcaagttcttacttgcaggctgccgcacaggaatataaactgtggtatgacgaacccgctcaggtttggactgaagcgcttccgctgggtaacgggcggttgggagcgatggtattcggcaatcccggtgtggagcatatccagttgaacgaagaaactatttgggcaggacgtcccaataataatgctaatcccgatgcgttggaatatattcccaaagtgcgccggttggtgttcgagggaaaatatcttgaagcacaaacgttggctaccgagaaagtaatggcgaagaccaatagcggtatgccctatcaatcgtttggcgatctgcatatttcttttccggggcatacacgttattccgattactatagggaactgagcctggattcagctcgtaccatcgtgcgttataaggtggacggggtgacttatcagcgtgaaacactgacgtcgtttgccgatcaggtagttatggtgcgtcttactgccagccaacccggaaagattacttgtaacgccaatcttactactccgcatcaggatgtgatggttgcgacggaaggggaggaggttaccctttcgggcgtatcttcctggcatgaaggactcaaagggaaggttgaatttcagggacgtatgactgcacgtactcagggaggaacccggtcttgtcgtgacggagtcttgagtatagaaggggcggacgaggctgtgatttatatttccattgctaccaactttactaattacaaggatataacaggtaaccaagtggagcgtgcgaagaactatctgcgccgggctgtaagtaaagattatatgacatcacgtaaggcacacgtcgattttttcaagcaatatatggaccgtgtctctttggatttaggcatagacaaatatgcaggggtaaccactgatatgcgtgtacagaatttcaaggaaacgaaggatgattttctggtggccacttatttccgtttcggccgctatctgttgatttgttcttcacagccgggtgggcagcctgctaatttgcaaggcatttggaatgataaattatttccttcctgggatagtaaatacacgtgtaatatcaatgttgaaatgaactattggccggccgaagtgacgaatctcagcgaattgcacgagcctttgatacaactgatccgtgaagtgagtgaaacagggcgtgagtcggccaagattatgtatggggcggatggctgggtattgcatcacaatacggatatatggcgtgttaccggagctatagacaaggctccgtcgggattatggcctacgggtggagcctggctgtgccgtcatttgtgggaacgttatctttatacaggcgatatggagtttctccgttcggcttatcctatcatgaaagaagccggtaagttttttgatgaaatcatggtgaaggaaccgttacataactggttggtggtatgcccgagcaattctccggagaatactcatgcgggcagtaacgggaaagcgactacggctgccgggtgtactttggataaccagctgatattcgatttgtggaatcagataatcacgaccgcccgtctgttgggtacggatgctgaatttgccacccgtttggaacagcgtttaaaggaaatggcgcccatgcagataggacgttgggggcaattgcaggaatggatgatggattgggacaatccgcaggatgtgcaccgtcatgtgtcacacctttatggtttgttccccggtaatcagatttctccttaccgtactcccgaattgtttgatgcggcacgtacttcgctgattcatcgtggcgatccgtctaccggatggagtatgggatggaaggtatgtttgtgggcccgtctgttggatggtgaccatgcttataaactgataaccgatcagttgactctcgtacgtaacgagaagaaaaaaggaggaacttatcctaatttgtttgatgcccatccaccttttcagattgacggtaattttggttgtacggcgggtatcgtagaaatgctgatgcagagccacgatggttttatttatttacttcccgcattgccggcgcaatggaaagagggaagcgtgagcgggattatagctcgtggaggttttgaattggatttgagttggaagaatggtaaagtgagccggttggtggtgaaatcccgtaatgggggaaactgtcgtttgcgttctttaaatccgctggcaggcaaagggctgagaaaggcaaaaggagagaatccgaataaattgtatgccatacccgaaatcttacagccgattataaataaagaagcgaaattgaataaagttgagttgaaaaaaacttatctttatgatctggaaaccaaagcaggtgaagagtatatattcttaggtaagtgatgattcttgcattgattgtaaggatgaaaaatagtaaaaagaagaaatatgaaaagaacaggattaaacattatttgctcattgttgctggcaggtggaatgtgtgcatgtactgccactcctaaacagaccgaagaaatcaaatggagcgaacgtatggctcagtcggaaatgcaacgtttcccagagccttggatgatagaaaaagcgaaaaagcctcgttggggctatacgcacggactggtggtgaaatccatgttggaggaatggaaacataccggtgacactgcctattataattatgcaaaaatatatgcagacagtctgatagacaccgacggtaagataaagaccatgaaatatctttcttttaatattgataatatcaatgccggaaagattttattcgatttttatgaaaagacgggagacgggcgttataaggtggcgatggatactcttcgcaaacaactggccgaacagccccgtaccagtgaaggcggtttctggcacaaactggtatatccgcaccagatgtggctggatggtatattcatggcttctccttatctggctcaatatggtaacgtattcaaggatactacggtcaatgccgatattgtgaatcaaataaagctgattgcccgtaaaacgtatgatcctaaaaccggtttgttctatcatggctgggatgagagcaagacacaaaattgggcaaataaggaaaccgggtgctcacccaacttctggagccgcagtataggctggtatgccgctgccgtggtggatgtattggactatatgccggcgcagttcgaaggacgcgacagcattatgacgattataaatacgttggccgaaggcattgtaaaataccaggagcctgaaacaggggtatggtggcaggtgactgaccagaataaccgtaaaggaaattatctggaatcctccgcttcatcgctttttgtatattttctgtgtaaggctgtaaacaaaggatatattcctgtggagtataaagcggccgcagagcgtggattcaacggtttgataaaacaattcattaaagaagagcctgatggttcatacactattaccaactgttgtgctgttgccggattaggcggtaaaggaaaccgggatggaagttttgcttattatataggtgagccggtgatagagaacgatccgaaatcagtaggttcctttattttggcagctattgaatatgagaaaatgaagcagtaggaataatctgaaaaagatgaggacatttgtcaaaaaggtcttcatcttttccgtaaacataaggaccttttttaaacaccttgttgttttgataaaagctcttgtttggagattgtcaattaattaataaacgaatttgaaaatacaatgatgaacagacacgcattactttccttattggctttattgctatgttgctctacttcgttgccggcgcagaaagcgaaaacgtatattccctggaagaacggcaaactggtggtgtccgaggagggacgttacctgaagcatgaaaatggagtacctttcttctggttgggtgaaaccggatggctgatgccgcaacgcttgaatcgtgacgaggtttcttactatctgaataagtgcaaggatgccggatataacatggtgcaggtgcaggtattgaacggtgtgccttccatgaatatttacggccagtattccatgacagacggttttaatttcaaagatatcaaccgcaaagggatttatggatattgggatcacatggactatattattaaaagtgccgcttcacggggcatctatatagggatggtatgtatttggggaactcccgtggaacaagggctgatgaatgaaaaagaagccgtggcatacggtaagtttcttgcagaacgttacaaggatgagccgaatattatttggatgataggaggggatatccgcggtgataataagacggaggtatgggatgcgttggcaaacagtatccgcagcatagacaaaggtcatctgatgactttccatccgcgtggacgtaccacgtcggctacttggtttaatgaccgcgaatggctggatttcaatatgttccaaagcggacaccgtcgttacgggcagcgtaacggtgatggtgattatcctatcgaagagaatacggaagaagataactggcgttttgtggaagccagtcaggcaaagactccgttgaaaccggtgattgatgacgaacctatttatgaagacattccacaggggctgcatgatcccaatgaaacccgttggaatcagcacgatgtgcgtcgttatgcctattggtcggtgtttgccggatcattcgggcactcatacggtcataatgatatcatgcaatttatccgtcccggatatggagcctctttcggtgccgacggacgtaagaaagcatggtgggatgctttggaagaccccggtttcaatcagatgaaatatctgaagaacttgatgctgacttttcctttctttgaacgtatgcccgatcagagtgtcattgcaggaactaacggcgaacgctatgaccgtgccatcgctacccgtggaaatgactatttgctggtttacaattactcaggacgtcctatgcagatcgatttgagcaaaatcagcggtgcgaaaaagaatgcatggtggtatagcgcgaaggacggtaagttggaatatatcggtgagtttgacagtaaagtcacttctttccagcatgatagcggttatctgagcggtaatgaccaggttctgattgttgtggattctgcgaaggattatgtgcagaaagcttggacagccttgccggatgccatacagaaatggaataagtaagaaatatgcatatcatgaaaaaacaagtattattaatcattcttctggcacttccgttgtggttgaaggcagcggatgtttcggttaccggcctgcgtaccgagcagatggtagatcccatggggttggatactgctgctccccgtatgagctggcggttggaatcttctcaaagaaatgtgatgcagaccgcctaccggatcttggttgcgtcttctcctgaacttttagcacaggataaaggagatttgtgggattccggaaaagtggaatccgatgcgtccgtatggattccctatcaagggaagcgtttgaaaagcaatcagcgtgtttactggaaagtgagaagctataccaatcgcggtgagacagaatggagcgagcctgcccgatgggggatgggacctttaggtgagattcattggaaaggacgatggataggttgggacgctgcgtttgcatgggatcgggaagattcacacagccgtttgagctctcgttatttacgcacggaatttaaaacgcaagccaaggagataaagtatgctacccttcatttgtgcggtttgggtatgtacgaactgttcattaacggccagcggataggtgatcaggtattggcgccggctccaagtgattatcgtcgtactgtgctttacaattcttttgatgtcaccaaacaggttgccggaggaaatgccgacaatgccatcggagtgaccctgggcaacggacgtttctacactatgcgtcaaaattacaaaccttataagattcctacttttggttaccccaagttgcgtctgaatctgattatagaatataccgacggcagtatccagcgcatcaacagtgatgagaaatggcgtttgacggctcaagggcctatacgtagcaataatgaatacgatggtgagatttacgatgcccgtatggaattgggaaactggacacagcccggttatgatgattccaaatggctgaaggcgcaacgtgcttcattgccgtatggtacactccgcggcaataccgctcccaacatgaaagtgatgaaaacgctgaagccggctgtcttcaagcaatatggtgaccgttatatgattgatttcggtcagaatatggcaggatgggtgcgtattaacatagcgaaagccgctgcgggagatacgatttgcatacgttatgccgaacgggtaaagaacgacggtacggaactggatgtggaaaatctccgccatagccagagtacggattattatatctgcaacggtaaagaaaacaacacctcctggagttctcgtttttcttatcatggattccaatatgtagaagtgacaggttataaaaatctgaaagcggaagatttggttgctgaagtagtatatgatgacttggaagataacggtactttcgagtgttccaatgatatcatgaaccgggtttatcggaatgcctggtgggggatttccagtaattataaaggagtgcctttggattgtccgcagcgtgacgagcgccagccctggcttggcgaccatgctatgggaacgtggggggaaagtttcatgttcaacaatggaaacacctatgccaaatgggcggatgatatccgtgaagcgcagcgtgaagacggttgtattcctgatatttgtccggcttattacaattattatacatcggaaatgacgtggtcgtccacattcccggtaatctgtgatatggtttatgaacagttcggcaacatcgaacctattcgtaagaattatgccgctatcaagaaatggatgcaccatatacgcagtgagttcaccacagaggatggagtgattaacgccgataaatacggtgactggtgtatgcctcccgaatcaccggaattgattcacagtcaggaccctgcccgcaagacggatggagcactgattgctacagcctactattacaaggtatcgcaaatgctggccaagttcgcccgtttgcaaggtctggaagatgaggcgaaggaattcgagaaggatgcagcaaaaatcaaagactgcttcaacgcccgtttccttacggttaagaagggaacttctccggtacaaacgccgcatgttctttatcccgacagcatattctatggtaacaatacggtgacggccaatatcctgccgctggctttcgatatggttcctgaggcctatagggaagaagtggagaaaaatgtaataacaggcattatcacccggaataaaggtcatatcagcagtggggtgataggtatgaactggatgatgcgtgagcttacccgtatggggcgtggcgatgttgctttcctgttggcaagcaacaagacttatcccagttatggctatatgatagaaaagggagctactgccatttgggaattgtggaacggtgataccgccaatcgttggatgaacagttgtaaccatgtgatgatattgggtgatctattgacttggtatttccgtgatttagccggatttaatccggcacagcccgcttacaaacaaatcatccttaaacctgatttttccatccaggagttgagtcatgtcaaggcttcgcacaacactttatatggcaagatgattagtaactggaagaagacccttacgcatttggaatgggatatcacggttccctgcaataccactgcattggtttatcttccaacgttggacgagaaggcggtaaaagacaaggacgttacctttgtacgtcgggaaggcaactctaccgtatggagtgttccttcggggaactatcatttttcggttagcatggacccttcttcaggtaaaaaccgtgcaggtatcgtggaagatcagttcctatacgaacaagcttcttttcccgaatgtcacggcgctactattgtggaattgaagaacggagacctggtagcctctttctttggaggcactaaagagcgtaatccggattgttgtatctgggtatgtcgcaagccgaagggcgcgacggaatggagtgcaccttatctggctgccgacggggtgtttagtctggatgatccgcaggctgtcttggcaggcattacggcagaatccactccggcggatgccggccccgtggcttctacgtttaaaggggacaagtcccgggcacgccgcaaggcttgttggaatcctgtgcttttccagatccccggcggagatctgatcctgttctataaaataggattgaaagtagccgattggagtggttggctggtacgttctaaagatggtggaaaaacttggagccaacgtgaaccgttgcccaaaggtttcttaggtcctattaaaaataagccggagtatgtggatggccgtatcatttgtccttccagtacggaaggcgatggaggatggcgtatccattttgaaatttcggatgataaaggaaagacttggaagatggtaggtcctgtagaggcggaaatgagtgtgcctacagctttgcgtaaggcaaatgcggccaatgtagacgatcaggaaggcggtgaagccataaaaggagaaggcgagaagcctatttatgctatccagcccagcattttgcgtcataaggatgggcgtttgcaggtactttgccgtacacgtaacgcacagattgccacttcatggagcagtgacaacggtgaaacatggagcaaagtcactttgcttgatgttcccaataataattcgggcacggatgccgtaaccatgaaagatggccgccatgtattgatttataatgatttcagcacattgccgggtactccgaaagggccgcgtacaccgttgtgtgtggcggtttcggatgatggcattcactggaagaatgtaatgacattggaagacagccccatcagccagtattcttatccgtccatcattcagggcaaggatggcaaactgcatgccgtatatacctggcgccgtcagcgtgtggcttataaagagttggatttgagcaaactgaaataatacaattgtggataaaggaattctttgatagagagtattggagaatttgaaaaaaacgggtgtctgaaataaaaatcagatacccgtttttttgaaaacagactcccattatccgccaatgaaagctctttctaaagatacagaatatgaaataattataaatagagtacaaacgtttcttattatcgtcctccctttataaagaaaagaataagtgacagattattatgaaaagcattagactactacttttactggcttccggagtaactacgggagcatttgcccagtcgggcgggctgacggatatgagccaaagtcgttttgccaagatggccaatacggaattaggtgccgtgcattggacagatggcttttggggcgaccgtttcaatgtatatagccatacctccttgcaaagtatgtgggacacatggaacaatcccgatgtttcgcatggcttccgtaactttgaaatagctgccggtgtttgcgagggcgaacattggggacctccctttcatgacggtgatatgtataaatggatggaaggggtggcttccgtgtatgccgtcacgaaagatcccgaattggataaactgatggatcacttcattgaacatgtggtgaaagcccagcgtgcggacggttacatccatacccctgtcatcatcgaggaaaagaataaggggattgacactcattcggacaaacagcaacagacggtaattggcaccaaagtaggcggtgaggacgagaaaggtgcatttgccaatcgtctgaattttgaaacctacaatttggggcatctgatgatggcaggtatcattcatcgccgtgccaccggaaagactactttattcgatgctgccgtaaaagcgacggacttcctctgtcatttctatgaaaccgcttctgcggaactggcaagaaatgccatttgtccctcccattatatgggtgtggtggaaatgtaccgtgctacagggaatccccgttatctggaactttccaagaatctgattgatatccgtggaatggtggaaaacggcaccgatgataatcaggaccgtattccgttccgtcagcaatacaatgcgatgggacatgccgtgcgttccaattacctgtatgccggtgtgaccgatgtgtatgccgaaacaggagaagaccaactgatgaaaaacctgaccagcatctggaaagacattgtgacccgcaagatgtatgttacaggagcgtgcggtgcgctgtatgacggcacttcgccggatggaacctgctatgagccggacagcattcagaaagtacaccaaagctatggccgtccttatcagttgcctaatagtacggcgcataacgagacctgtgccaatatcggcaatatgcttttcaactggcgtatgctggaagtgacgggcgatgccaaatatgcggatattgtggaaaccgccctttacaacagtgtgttgagtggtgtcagtctggatggaaagaaatatttctataccaacccgttgcgcatcagtgcggatttgccatacacacttcgctggcctaaagaacgtaccgagtatatcagctgcttctgttgtccgcctaatacgctgcgtaccgtttgtcaagcccagaactatgcttatacggtgactccgaatgcggtatattgcaatttgtatggagcgaatacactggctacaactttgaaggaaacgggaaagatcgggctggtgcaagaaacggagtatccgtgggaaggcgctgtgaagctgactgttaccgaagctccgaaaccgtcaaagaagaaagcgttttctttgttcctccgtgttcctgactggtgcgagaaggcaactttgaaggtaaatggcgaaccggtgcaaggaacctggaaagcgaatacatacgccgaggtaaaccgcatctggaagaaaggggattgtgtggaatgggtgatggatatgcctgtaaaattgctggaagcaaatccgttggccgaagaaatccgtaaccaggtagtggtgaaacgtggcccgttggtctactgtttggaaagtatggatatagaaggcgggcataagatagacaatgtgctgatacctgccgatatccggttgactccgaaaaaaataaccatcgaaggcagtccgattgtcgcattggatggtactgcccgtctggtcgatgaagtatcatggaaagataccttgtaccgcgaggtaggaaaggccgacaaaccggtccatatccgtctgattccttattatgcatggggaaaccgcggaaaggctgaaatgacggtatggatgcctttggcacggactaatcactaaccacttacccctaattagttacaaatgaaaaaaatattcataaccactgccgcgctgctgatagcttgtacactgtcagcagccgatttgttcgtatctccggaaggcaatgaccggaatccgggtaccaaagactttccgaaagccacccttacagccgcattgcgtcaggcaagggaacttcgtcgtcttaatgatgaaagtgtaaaaggtggcatcaccattcatttggaggcaggtgactaccatctgtacgaacccgtctttatccgtccggaggacagcgggacggaagcttcacctaccgtcatcacttcggatggaaatgccgttctgaatggtggggtggaaatcaggaactggaagaagcaaggaaagttgtgggtagccgatgttcctatgtttaacgggcgtccgctggatttccggcaactgtggatcaatgggcaaaaggctgttcgtgcaagggatgtggcagactttgaaaagatgtaccgcatcatcaacaacgacccccaaaacgaaatactgtgggtacctgccgctgccgtaaagaaaatacagaaggcccgatatgccgaaatggtccttcatgaaatgtggtgtgtggcaaatctccgtatcaagtcggtagaaatacagggagacagtgccgccgtgcgtttccatcatcctgaaagccgcatccagttcgaacacccgtggccgcgtcctatggtgaccaaggatggtcacaactcggctttctatctgaccaatgccatggaattgctggatgaacccggcgagtggtatcacgacattgaaagccgtaaaatatattattatcctcggaaaggagagaagataagcaaagccgtagttcccggcatcgaaacgttggtatgggtggaaggaacgatagaccgtccggtaaagcacatccgttttgacaatattgctttccaatataccacctggatgcgtccctctttgcaaggtcatgttcctcttcaggcaggtatgtacatgacagacggatataaaatccgtccttccatgattcgtaagaacaatcataagctggataatcaaggttggttgggccgtccggcatcggcagtcgtagtcaaggctgcctgggatattgatttcgagaagtgccgtttccagcatttgggctctacaggcattgattatgaatgggccaccgatggaggacatataaacggctgtctgttccgtgatattgccgggaacggtattgtagcgggcagtttcagccctgccgctcacgaaacacatcttccatacgatcccgccgaccgtcgtgaggtctgtaccggactgaccatttccaacaactacatcaacgatgtgaccaatgaagactggggcactttgggcatttgcgccggttatgtaagtgatatcaatatcgagcataatgaaatcagtgatgtatcctattcgggcatcagtctgggatgggggtggacacgtacagtaaactgtatgcgcaataaccgcgtgcacgccaacctgattcatcactatgccaagcacatgtatgatgtagccggtatttatacattaggttcacaaccccatagccggattacggaaaattgtgtttccgacatattttcacccggttatgcacacgatcccaatcattggttctatctttacaccgacgaaggatcttcatttatcaccgtcaaggacaactggacggaaggagagaagtttctgaagaacgccaacggtccgggtaatacatgggaaaacaatggtccgatggtgaacgacagcatcaaggcaaatgccggactgcccaaagaatatagctatttgaaggaaaaataaaacgtgataccattatgaaaaacaaacttgccactttagtcggagcacttgcattgagtgctgccgcctccgcccagacctggatctggtatccgggtgattatgagatatggctgggcaaccggatgaacaaccgccgtacggaacgcggtgcttttttccctcccttctggaaaacggacagccattatgtggtagtggaattcagcaagaaattggatctggcggaaccggaagaaatcttcattgccgccgaaggaaaatacaatgtgaaattggacggcaaactgcaattcggtatgccctccaccttgaaactccccgcaggaaaacacagtctgaacatcaaagtgtggaatcagtccactccccccactatttatgtgaaaggaaaaaccgtaaatacggacaagacctggaaagtaacctacgaagacaaggaatggatagacgaaagcggaaaagccagtgatacttctgccaccgtttatatggatgcagggtgttggaactttgacggagccacccaactgccttccaagttttcattggccagaaaaccgatgaaagcagtttcctccactccccggaaagaaggggtattgtacgacttcggaaaagaaacctttggttatatcactctgaaagaggtaaagggaaaaggaacgatccatatctattacggtgaaagtcctgaagaagccttggatacggaatattgcgaaacattggacaaattgctggcagagccggggcagataaccgatctggccatccggaatacacggaaactatacgatgaatacacgttggacaacagcaaggccttccgttatgtctatgtcacttgcgatccgggagtaacgatacaggacgtttccatgcaatacgaatacctgcccgaagagtaccggggctcattcaaatgcaatgacgaagagctgaaccgcatctgggaagtaggagcatacaccatgcaccttactacccgtgaattctttatcgacggcatcaagcgcgaccgttgggtatggagtggcgatgccatccagagctacctgatgaactactatctgttcttcgataatgaaaccgtgaagcgtaccatctggctgcttcgtggaaaagaccctgtgaccagccacagcaataccattatggactacaccttctattggttcctcagtatttacgattactatatgtactccggtgacaaagactttgtaacccaactctatccgcgtatgcaaagcatgatggactatgtattgggacgcaccaatgccaacggtatggtggaaggcatgaccggtgactgggtattcgtagactgggcagacggttatctggacaagaaaggagaactctcctttgagcaagtcttgttctgcaagagtttggaaaccatggcgctttgtgccggtctggccggcaatacggcagacaaaaccaagtatgagaaactggcttccgctttacgttccaagctggaacccgctttctggaatgagcagaaacaggcgatggtacacaaccgcgttcagggcaagcagagtgagtccgttacccgctacgccaatatgttctctgtcttcttcaattatctgaatgccgataaacagcagaccatcaaacacaccgtattgcagaatgacagtatattgaaaatcaccactccttatatgcgtttctatgaactggaagcactgtgcgccttgggcgaacaagaatcggtgatgaaagaaatgaaagcctattggggcggtatgttgaaagaaggagctaccagtttctgggagaaatacaatcccgaagaaacaggtatccggcatctggccatgtacggacgtccatacggcaaaagcctctgccatgcatggggagccagccccatctatttgctgggcaaatactatctgggagtaaaacccaccaaacccggttacgaggaatactccgtcaccccttgtctgggcggcttgaaatggatggaaggaaccgtgcccactccatacggcaatatccatatctatatggataagaaagagatccgtatcaagtccgacggcggaaagggagtgctgaacattccaacccggaaaggaatgaaagccatgaccatagaacccggagaagaacaagtcttcaaatactgatggaatagatcaaaaaaaaggtgatacctaccttcccaggcgggtatcaccaatactgtttcgtaagttcccgttatccgctgataacagtacttacctctgatctaacattagttttcttatgggcttccgcctgtatcactacattaggaagcggagattctacatcttggaaaaaagtatcttccaaaagcttcgctttttagtctcttctttattacctgaactttgataaatatcttcgtatccccatttgtcatggatcattctgtaaatcatcccccattcgggcagtcctcccagattacggtcatcaataaacaaatccgccttcagttttctggagtaatgattactttccagggtttcttccgcataattgctgtttacggcataaaactccagtccacgctcccggcagaaatccacggcctcctgtaataatttaccttcccgcacactccacagaataaggcgatgccgttcctgttgtagttttttcagcgtttctatggcaaagggtagttccctgcctatttcgggatatttatgctccactattgtgccgtcaaagtcaactgctataatcattccttatattttcgaaaattctttaatacgctgctcctctgccagtctgcatatcagcagggttccctctttctcggctatgatatacccgtccagtccttgtattaccgcctgtttcaaatgcggtgtgtgtacaatgcagttattgcattcatacattcggacattctcgcctacaacggcattgttccgttcatctttgggcagcaaggaatgcaatgagccccagctacccagatcagaccatccgaactctgccggcaatacataaatccgttccgctttttccattacggcataatctatggatatactttcacaagcagggaacagctcttctatggtttctttctctctttcggtatagaactccggataaatcctgtcgaacacctcggcaatgcccggtgcataacggcgtatagcctcttctatggtctttacattccatacaaagatccctgcattccagaaataattcccggcgtccacatagtgccgtgccgttttcaagtccggtttctctttgaattcatccactctccgtatatcctgatccacctcttctcccgcggctatatatccgtatcccgtttccgggcggcaaggtctgatacctatggttacaatagccttgctttgatctgtcatcagcagtgccttggctatcacccggcggaattcatccgtattgataaccaatgcatccgcaggagtcactacgatattggcgtgcgggtggtgtttcttgattttccagcaagcgtatgtgatgcagggggccgtgttacgtgcaaccggctccgtcagtatatgatgaggcggcacggatggcaattgtttccttaccgtctccttatacttatccgaagtcactatccatatattatccggaatgcacaaccctttaaagcgttccactgtcagttgtatcaggcttttgccacatcccgtcacatcaatgaactgtttgggacattccggcgtactcatgggccagaagcggcttcctatgccgcctgccatgataacgatatgagtttccataacacgtatgctttttatttctttttatattccagataccattggtacatcttgtgcaccccttcctctatgtctattttgtgatgccatcccagttcatgcaatttggtcacatcggtcagtttgcgcatggtcccgtccggtttctccggattgaatgtaatgctgcctttatatcccgtttcctttactatcagatgagccaggccggcgatggatatttcctttcccgtgccgatgttgatgtggcagttgcgtatctcttttgtgccgggacggtaagtatctttaaagtccacatgctccatgatgaaaacactggcatccgccatctcctcactccataagaattcgcgcagcggcgtgcctgttccccacagttccaccccgtccttgctgatgccgtagtttttcaggacagccagtatctcctctgttctgctctctccgtttataccttccaccgggcgcatatccagatcatagcgtatgttctcccagtcaccctcgttcaggcatttggcaagatgtattttcctgatcatggcaggcagcacatggctgcgttccaaatcaaagttatcattggggccatacaggttcgtgggcattacagcgatatagttggtaccatattgcaggttgaaactctcgcacattttcagccccgctattttggcgatggcgtatggctcattcgtatattccagcggggaggtgaggagagcatcctccttcatcggctgctgtgcatctctgggataaatgcaggtacttcccagaaacaataatttcttcactccgtgacggaagctttcccctatcacgttctgttgtatttgcaggttcttgtagataaagtccgccctgtatgtgctgtttgccatgatacctcccacgtgggcggcagcaaggattacatattccggtctttcttggtcaaagaagtcctttacggcaactccgtccagcaagtccagttccttgtggcttctgccggtcaggttggtgtagcccttttcttgcaggttacgccaaatagcggagcccacgagtccgtggtgccctgctatataaattttggctgatttctccattgaaattcttgactaatgatttaacagcttgctttgagatgaagtttcttcacgaatttcatatcgtgtttcaccatgattttcaccagttcctcgaatgaagtcttgcggggattccatcccagtaacgttttggctttggtaggatctcccagtaattgttccacctctgccgggcggaaatatttgggatccacctctaccagcaccttgcctgtagctgtgtcaatacctttctcgttcacaccttcaccttcccagcgcaagtcgatgcccgcttccttgaaagcaagggtggcaaattcgcgtacagtgtgatattctccggtggctataacaaagtcttcgggcgtatcgtgttgcagaatcagccacatacattccacatagtctttggcatatccccagtcgcgcagggagttcagattccccaagtacagtttatcttggaatccttgtgcgatgcgtgccgccgccagggtaattttccgggtaacaaaagtttcgccccggcgttcactttcgtgattgaacaaaataccgtttacggcaaacatgccatagctttcgcggtaattcttggttatccagaaaccatattgcttggctactccgtatggagaacggggatagaaaggagtagtctctttctgaggaacttcctgcaccagtccgaaaagttccgaagtagatgcctgataaatcttggttttcttttccagccccaatatacgtaccgcctccagcatgcgcagcgtacctaccgcatccgcttccgctgtgtattcgggcacgtcgaagcttacttttacatggctttgtgcggccagattataaatctcgtcaggttgtacggactgtatgatacgtatcagtgagctactgtccgtcatatccccccaatgcaggttcaccagtcggttctgcttcatatcccgtacccattcgtccagatacagatgttctatacgtgcagtgttaaatgaagaagaacgtctcaggataccatgtacctcgtatcctttttctatcaggaactcggccaggaacgaaccgtcctgtcctgtgatacctgaaatcaatgctacttttttactcatattttgtattattattaaaaaaatgttttatatcatgacctgtcttcatgcatacttgcatttggaccggtataaataattcttattcttttttatttgctgcgtcaggttgtatcaggctctcttcctctgcttccggtatttcactccacggcagtctggcttcaatgaattgtggaatctttgaaagaattttgcctttcagcgccgagatgggttttatgccgtgacttttatacattctcaagtcctccgcccatttcagtttgctttttcccgcatcggtagaaagcccccccattctcattttcacaatgtatttgttcaggtaatatactttcaggtcggcttcatacagatagcgcaccagcaaatccgagtcggcggctatcttataactttcgttgtaaagcccccatttatccatacactccttctttatatagacagtggggtggagtgggagccatccgtttttcacattctctttactgtaccgtccgcttatccagtttcgtatcatctggttggtgtcgtcataatctacaaagaccccgttgccgtatatcatatccgcatcttgttcctcgaatgttttcactatgtcggagatggtgtgagatgagaacaggaaatcatcggagtgaatcagaccgataatatctcctgttgctgcacgtattcctttgttgatcgcttcatacatacctttatccggctcggagataattgtatctatcccgtttttatattcattgatgacagccagcgagttatctttcgacgctccgtccaccacaatgtattctatgtcgggataatcctgttccagcacactttctattgctccacgaatggtggcttcccggttgtagcaggaagtgataattgaaactttcataatgttgatgcttttataatgtaagtggttatttatctaaatacgtttcttttatgaatgccttgattttcttgtcattccatccaaagcgttttttaatttcataaattttggcatctaccaggaaacgataccagaaaccttgtaaaaagtgccatataaagccctcttttccatccagaaatccccctttcagaatgtagcgtatattgaaattgataaatggccgtaagaatagcggtgcttttatatatttcactttcagccaccgtttacgctgttcctctgtaccccaaaacttggcctgtacttctttgcctctgtcgtccagtccgtattccatcatcagcatatccgccatttcccgtgtagcatatccattgtgcttttctgtccaccaggtcaggtcattcaaattggcgtccacttgattcccctcttccactgtgattgttgttccactgaagatgcggatatgttcatccatccatcggttctcacactccccatgtcctcttcgccatactttcaggtggtaagaaggataccatcccccgtgtagcagaggctttcccataaaatctatacgcttgcggacgtatactccatttacctcattgttacattccgccaatgcttttttcatggcaggtcccaagttaccctccaaaaactcatcagcgtcaatgcgccatatccattctgttgtaatgggacaattcttcagcccccagttgaactgtgtcgcatagtttttccaaggattttggtaaacttgcgctcctgcttctttcgcaatttctacagttcggtccttgctgaaagaatcgatgacgaatatttcctcacagatatttttaagcgagttgatacaacgggatatatgtttctcttcgttgtatgtaagaatgatggcagctatggaattattcatttttcaaaattcttttttttatatatttagccggatttcctgcataaactccccacggctctgcatctttcaccattactgtacctgcgcctatcacagcaccttccccaatctctatatcaggaccgatgaatgtattagcgcaaatccatgtctgattgccgatacggatttcgggacgtagtaggggaagagccggatcggtatagtcatgtgtgcctgcacatacatggacccgatggctgacagtagctttttctcctattgttactttacctaaattatagatcagggtttcttctccaatggcactccaatcgcctatttccagattccacgggaaccagataacggtggaggagtagatatggacatgttttcctattttagctccgaataggcgtagtatcgtatttctgtatccgaaagctatacggggagaattacggaaaaagaattttccgaatgtccacagtatacgttttacatagatccatttggagtagttcagatgattgcggttttctgctatgttgagttccatgtttatagacaaacttttttatatagttcaaccatatcttgagcaactttttgtgatgagtatttttcttctattaattttcttccattttttcccatttgctccagttgtgtttctgtacattgcagaaattctttgagagctttagtcgtagcttcggttcctatttctgtccaccatccgcaatgataactttccagctcttgccatggagttccttgggtagttatgacaggtgtaccacatgcaagtgcttcacctaccactataccaaagttttcactatgtgtaggtagaacaaacagatcggcttttttaaaaagttcccactttttatcaccgtatacacctcctatgaaatgaattaaattttcaacacctaatttagaggctaattgctttaattcattgatatagctttcttcaccttctcctgcaatgttgattgtatatccttgtaattccgtttttaaattcgctgtagcttctatcaagaagttgatacccttttttacatggacacgacttaaaaataagatattcttattccgtatccatgactccttcattgtgatcttatctatttccacacaattaggaattacttctatattattgttccatcctagctgcgtaagattatgtttttcactttctgccgtagcgtgtatgacgtttgctatttgtattcctcgtttttggaatagcagtgatgcgggaaatttttttgtccaataatgacgtttcataatccacggttcaagcattccatgtggagtatatactacagtatatccgatattcttagcccagatagtagtgcgtgctgataatggtaaccaacaactgttcgcatgaaacacgtccggcttgatatcattgagcagagttaaaaattccgtttttcctttgtttgagaaaggattgttatttttcggtatatagtgaacggtgcagttttccaaagtcaacggatttgcctcgcgatgggttacaacgtggagttccaccaattttcccaattcggttgttagcagttgcatgtatgcaccgacaccacccgatgtgcgatcaatactggggatgtaatgtagtattttcattgtgttttttgtaaaatatcttatcgtccacctgtgcaaatactataaatatgtggcattattcgtttaaaaccaatgccaataataatccatattactgcaaatatccaagggcttgcaagataactgaatgcaaatccaaaacttgaatgatggaatgggataattaaaatttttctgataatatttaatgtaggtttatggaaaagataaatgaagaaagtaaatccacacgctttcatgagtacattatgctttttaatttcaaaatcctttggacagaacttgtcatataaaatccatattgaggttaatccaataataattattggaatttttatttgtttccataattcacatggatataatatctctgttatacacaagacggtaaagataactggaataaatatagatttcaaatttgacaatttatctaaaaagcaatatccaaacataaaccaaaacatacctgataaaggcagaaatggtattgcgaaatagttcagaaagaatagtattccacaaactgcatatttgctggttttttcgctcgcataaagtaatataggagatagaacaactataaatattaaatcacgaagaaaccaaagatggaatgcgtatgggctgccgtttcctgaatcaaaatatataaaatttaagatcttatctattggttgatgaaaatttttagaaatccctttattatttacaaattgttctatgccaggaataaattctaatactaaattaaatacaacaggaaaaagacaggctataatataaggaacaagcaatgtttttcctcttttctttattttgaaccacaatttttggtaattagcatttcctccatcataaagacctgtgaagaataagtatccacttatcgcataaaataatggaactgcacatcgtcctatcattccactaataaaactctgcaaattagcgttgaataccattccttgtatttcattgggatagtcatgaaatccagagtggatatataatacaagaataatggatattaatgatagaactttgaatttatcacttaaatattgtgtcatgaatttatctgtttatttaaaatagttaatcccgtctgaatatatctcgggtataaaccttatcctgtacgtcatctaggcagatatcataacggttggcaatgattgcatcagactgggctttaaatgatgttagttcattaaccacacggctgccaaagaatgtcgaaccattttcaagtgtaggttcataaatgattacttctgcaccctttgcctttatacgtttcattacaccttgaattgatgattggcggaaattatcagaatttgatttcatggtaaggcgataaacaccaataatacaacgtttctcatccgaagggttaaatttgccatgattgtaatagtcataatagcctgccttatttaatactctgtcggctatgaaatccttgcgagtacgattgctttcaacaatggcttctatcagattttccggaacgtctgcataattggcaagtaactgctttgtatctttaggcaaacaataaccgccataaccaaatgaaggattgttataatgctgtccgatgcgtggatcaagacttactccgttaattatagcttgtgtatcaagtcccttcacttctgcatatgtatccaattcattgaaatagctgacgcgaagtgcaagatatgtattggcaaatagtttaacggcttcagcctcttttagccccataaacagtgtatctatgttttctttaatggctccttcttgaagcagggctgcgaatgtttttgctgcctgttctaaagtggaaatatcagctatggcacggatagctgaattttcttcatcaaattgtttctctgtgattattttgggatagccaacgataatgcgacttgggtataaattatcataaagagctttgctttctcgaaggaattcaggcgaaaaaagcaaattgaattttttgccttgtaactgcggcgtttctgtaaatattttggcatattttacatatagattgcggcaatacccaacaggaatagtgctcttaattaccattatggcattaggatttacgcttaaaacgaggtctattacttcctctatatgatgagtatcaaagaaattttttgctgggtcataattagtcggagcagcaatcacaacaaaatccgcatctttatatgcttttgctccatcaagagtggcggtaaggtttagctccttttcttttagatatttttcaatatactcatcttgtataggagaaatcctattgtttattttttctactttttcggctattatatcaacagcatagactttgttgtgttgagctaaaagagtggctatacttaatccgacataaccagttccggctactgctattttcatatccatattatattaattatttaaagaatacttaaagcatttgctaccatgttttgaggagttaataattgtgctaccttttttttagcattcgctcctaattgttttatctcatcattcgtcaattgcgatattcgtgttatgcaatcgtcaatattcgtaaatattaatccgtttgtattattctcaatataagaatattccacacattgcttagtttcctctgagcgtataaatgtgcaaatgggtttaccgtatgccatagcctctacaatagacagacctacccatcctggttgaaaatataaatctgcaatgtaaaataattcgcgtttgatattggtgtcgtatatggcaccaaaatcatacacattgttataaagggaaaaatctggtttgttttttcctgcgcctattataatgaaaccatatttttctgtattcagctgtttaatggtttctattaataaatctgtccggcgataattgttttcaaaacgtgcacaaaaaatcagtatattttcttgtgtgatattatatttacattttaattcattttttgaatttacaggcttgtactctaccatttctgttacacctgttaatgtattatttaaggctacaataggtttgtttgggaaaatctttttccattgattggcatctttttctgtataaatccaaacgccatcagcaagacggatctgcaatttcaacttccagtctggttgtttttcttcctgtaaatatctttttacgctgatgccctgtccccataatatgatttggcggcgatgaatgaatttagtcagtagcaatagccacgttgtcagatgtgcaaaatgtagcatcaataccaaagtgtcatatttccataggataggaaatggattatatatgagtattccttttattttcttgtttgcaatatatattagattttcaaaatcaaccttaaagccggattgtttggtagaagataatggattgaatataaaaatatccaatttcttcatgttattagccaatttttggaaaaattcagtcctataatgaggtacttctggttgtaaaattgccatttttacaggctttcttatcttttgcatatataaatttgtctagttccttcatgtatactgtcaaaagccaccatttttccattggcatcccaacgaggatgtagatcgcagtgtaatcctgagcgtgtgaaactgaataaagatggtgaaaaaagtttcattatttctaaatctacaccttgagaaaattgtataaaattgtctgtgacgggttgctcatcagacattctaaatgttcctagatttgtgcgttcatttttttcaaaatcataaaagaacaatgtacgacagtgtgttaacttatccggataattatcgcaaatagcaatattccggtctgtcggacaacacatgggatgaccatcctctgtaataattccaagggcaaaaggtttgatatctttaatatccttatccatgcacattaaaaaactcatagacataccttttgaacgttttaatacctttcttgccaagctcttagctactcccataaatggttttatgagcggatttgaaaataaaggattactgcgcatagcatctatatttcctcctgcacgtccccaaataaagattgaattgtcatttctccaatcgaaatgacttaggaaacctacagctaaacatcttaaatctttaccatctacgcctattgtcataagtcttgtacgtaaacctccatcagaaagaaaaaatctatgcagaaaagcaatgcgttttccgtttggactcaaaactagatgagtaacataatgatgaaatccattatgtgtagatgtggtggcatcacattcacttatatcttgaatgctaaccaatagctttgttgtattattttcaatgtctgtcacatatatgccatccttttcaggtgtttctttattgcaatatggatcatcaatgcctatatatccataaccacccaatctgtgaagacgagcataatttatgccaaaacatttctttttgtctgcgcttaaaatatggcaggtggaatctatcgtttttactttttttccactttccacattgtagatgtctgctccccaatgatcgccaactctattgttgacaataaaatgtgtattgtctatccattgctggcgtgctccttgaggataattcatcgcacatgtttcaccaagtttgacaaattcttgtttctcccataatacatatcccacaccaaactgttcaccgggtaatggaggcctattaataacatctgcttctaaagaaagtaatttttcaccagtttggttaaatgcaaccaaatcatggaatccaaagaggtgatgtttgggaccattggtagctctaattatttgtttcataataaaactatttccatgttaactttatccaattgtctaattcttgtgctcgaacattccaagagtgtttttctgcatgtgcatcagctgtatatttattgttttctatgatcttcttcatttgtgtagccatatcttttgcattacctgaagcataataaaatcctttgtcctgaagtatttcatatggttcacctatcttacatgtgataattggttttttataaggtagatacaaatacattttgcttgggcaacgtgcccaatcctgagttgtatcattcattggagatatgaatgcagatgcaacgctaaagtattgagaaatatcctcttcgtctacaaaaccaggcatttctattatatcacttaaataattttcagatacatatgtttttgcatcttcataatgacgacctttgcccaatatcagtacattaaaaggacgggtttgatctttgagttgcttaactgcgtcaataatagtaaagaccccataatttctagtaacagtccctaaaaatactaatgttggttgggataaatattttttaaatttatctttaatattttctttttctattactttaaccacattggtattaaaggcataaggataataaagcataggtattttttccttaaatacttttttagatcgtcttctgtaaatattttgaagatatttactagcatttagcaatccatcactatatattatggaataatactcataaatatagcaaaaaagtttgcgtaatcctttcatgtccggtatgcccgattggagttcggaatgttcaactattttcttacatttatgctttattccaacaatattgcgtgtaacaaatgcacatatatacaaaaagtctggattaatttcttttattaagtcgtcttttttcttacgttcttgtgtcatcgaacatttattaaaaaaatagagattaatgcgagagtcacattccatcattgttctatgtttgttttcttcgcaattttccataataatggaaacttcccatcctaaatcagccaggggatttgctagtcccagtgctctttttgctgttgcaatattctttatatcaccggttgtgatgaaacaaattttcataataatattatttaaattaagacatttataaaatcattgtatctagatgttgcaatgattatgatgacttagatattaccctgttgtttatgattctgttatagctattttctatattaattcttttttttattctcaatgcacttcttgatgaaattattagaaatgccatatatgcaggaaggtatttgaaatgaggtagaggggagaatagtaaatgccatgttatgttcattaggcaaaaaattctatataactgatacctatcattgcacatcaatgaataaaaagtatattttgctgatttataccataacaggaaaacacatatcaatgctccaacaccaaatgcacacgcaaagtagaacaatacactatgaccaggtatgcgtttataatggttgattattttctcataatgtttatcatcccccccgctcatgttgaatagcattttggcatatttatgcccaacatctgttgcccaatatccccatccaaccaacggactatccataaaagcataaaatggaattaaagaatcagttcttcccatttttagtatctctattgggttataaggatttgaactttttagtaattgttctgtatttcctgcttttatatttcctgtcattaccattggtacatagacacattcataaagtagtaagatgcatgtgaagatagtcagtagtcttttctttagttgaggaattcggattttattattcgatatatatatgtaaatgccacctgctataaataatgtaagacctccacttctagctcccattattataaacaatgcacctaaataggtcattgctaatgcaataattttatgccaatgctgctttttgataaacaatgtcagtagcattaaacagtttgtaatagctggaaccacaaaaaacttgaaatatgttacattttcttctgaatatccactatccagattctgttgaaattcggatggaaataaatatggagatagtataagacctaaaacataccattgtattgttttgatgtcttttgaataaatggtatagaaaaagaaaaaatgtactatacctgtgattgtcacagcaataccttttatcttatccaatatcatgttacgatcatggaacaactctgtgataaattgaaccaataataaacataagaataattttagtgcccattttataattttgtcattttggtctatttgagataaccaaaaaggcattgttagtataattaatataaacgaacccgtaacttctcccacaaaaggcacaataaggttattggcaagacctaatatgagagcaaatataggagaaaatataaatttattcatatcattttattatatatgtcagcaacatttgctgcatatttttcccatgtgtagttatttgaaatcagttttgaagcggctataccgagttgtgtgcgcataatttgattattgcgtaattttaaaatagcatcaactatatcatcaacatgtttagattcaatcacaagtccatttttttcatttgtaataggtaatccactttctatagtagcaataacaggtagccctgcagccattgcttccataccactacttgcacaaccttcacataatgatgggaacagatatatatcagcttcggataaatattgtttaagattgtcctgaggtaccatgccaatgagtttaagatgtttgataggatattgctttaataatgtttgagcttcagcattactgcctacaacaatatattcataatcaacttttaattcatctaatttttgcatggcacgtagcgagtattccgcacctttacggaaaccgaaaccaccggtgaaaagaatttttaaaggtccggttagctcgtatgatttctttaagccaaaaaaatctgaacgaacacctaaatacactacatctattttatttgcgtcaaaaccatattcaataaaagtattttttacaaaatcagaattaacaagtagacgatcaccttcttcgcaatcgtacatgatttccttccataatggattagagattcccaaattaaatggtgtgttgtttttttcaaattcatttctcaaatgtttttccatatatgctggatgcgcaatactatgatctactaaaactttaatccctttactttgggcgtaaataattgcaccaccgcgaccagacccactacgcacatgtaatatatctcctttgattgtgtatttctttgagaattttccaaatagctcatgtgatttaacatttagtataatggccctttctccgtttagctttctcgccacaacatttaaaaattcaggaagaaaacaaccgtgattttttccgttcaagcatgatggagtacgtttcttgaatgtatgctccaaatcatatttggcgattttacttgccaattttaatccccaactattccaccatgtaggtatccatccttggactacagtcacatctactatttgtgacaggtattctgcactttttattagatgaagaggaccaagagttgatattgtaacttttactttttgcataatattatcaatttataaattaattgcactaatatttattcgccaaataatagtaagctcaaagttttgttcttatttagaaatttataaataaagactgacagaaggatatctattgcagtaaaacatgttagtattattagattatttgtgttaatatgtaatattttatttattattaggaacttctggtgcaaaacgtaaattggtaatgtaattaagcctatttttgcaattaaaatagtgatatttttaatcttttgtaaatagcttgctagccatataacacagatacttccacttagtcctgctataaagcgtataaaagctgacaaatgatagtctattgtaaaaatattatcggacattcgatacattgaatgttcaaatgtatagaccttcattgtaactatgaatatcaataaaaataaaattcctattttataagaacatttactccaatcgtattttcttagggctattgcaataataaaaaaaggcgtaagatattttaattcacgcatcatccataattgaggggcaatataaattatcaaataaatgacactccaagcaatatatttatattgggcataaaatcgttctatcattgctcctattatctgtaaaataaatagtagagtaagataccatgctcctgttaatgttaaattaataaagtatttaaaatcaatatactgtgaactaaataatttgcttcctccaattagaaaacaggagaatagcccccacatcagactgggcaagtatagatgtataaagcgtttttttataaagtggttataatctgttttttttacgctcggatagaaaaagtatccacttataagcataaataatggcatatgaaatgcatatatggttttcccaataatcgaagattcccaattagagttgaatgtttgcaaaacatgtccatatgcaactaaaattattgctattcctttaagaatatcaaaatatatgtttctagatttactgttagtaacttgcatgttcaatggtatatcttccattaattttatagcacactttagttatgttgctttttttttaacagaatatgataatcattccgaggtctaaataaatagtctattcttatttctaacaatttgcaataattagaaagtatatatgtcattactgtttatttcattttattcttcaagaatgtacttatcatatttttttcttgtttacttaatccgattactataatgattaaacttaatgaaatgctgtttaaacagagaatcgagattaacccccaaatagtctgtggaataaacaatgtaattattttgcatataaacaatgctgctactgctacgcagaagcaaggtttgattacttttttaagcaattcatttatttttatgattgaaacttttgatgctatccatactcgtattgtgcaaacaaatatttcatataataccattgctattatcaggtcattaggattattggttattatgccggtatagtagctgataggcaaaactaataaatatatagcttcgggccatatcataaatttagtaatattaccggttgcatatactgctgttcgtattgtttcaaaagaagcataggtaagactcagaaatatggtgcattgtgcataagtcactgcatatggtggcacattacctagccagagttgcatgatatattccgtttgaaaaagaaatggtatcattataaaaaaaataagaaagacttgaaatttacttcctgcatagacaagctttttatgtatatccagctcaccattggcatatgtttttgttatttgtggagcaatggcacgttgcaaattttgagcaaatgacaaaactgagtttttcaactgcattgaaattgtatatacagcattaatagccaccccgaatgtaagattgataacaaggataaacccttgtgacgaaagaacctgcaaagcaccggaagcagaggatataccggcaaatttgccaatttgcattatttggtttttgtctataatcatatggtaatggacttccggaaatttgcgatggcaatatatctgataagctattcttattaatatgcttattgttgccatcaatatagcatagattaataaacggccggtaggaaagtaactaaggcaataggctgaagcacatgttaagattacttgaagaatactgatagcagcaaaagcattcattttttcatgtgctacgattagtgaattataaggaatacttataagattgactatacaagtgagtactgatatttgaaacacccattgggctgcatccatactttccgctggtatgtttattttggtatgtagaaaccatagacctccgacctcaagtagtataaatatgattccggacaataagaatataacatttaagcaagaacaaaatactttatttggatcaccgttatcacgtcctatttcataggtcagaaaacgttgtacggcattgcccattccactactgaaaacagcgaacatactgacaatactaccaacaacaccatagattcccatatcctctacaccaagattggcaagtgttaaacgtgtggtatacaaatttaaccacatcgtaaacagcatacgtacataaagtaaaatggtgtttttagctaagcgatttttgttaaaattgtcagacattgatggatggaatgtttattttaaaagtttttcttctatttgtttaatagatatctttctgatttcaagaaaaaatgttatttttaatgagctaatagtcaacaatatgaatttagaaaatttcttccaattaaatttctcttacaggatgggtcaggtttcatttaccaacgaatgaatcttgtttaatattaactatttctttatggaattctatattccgacccaagataggatatgaaccttacctctttttcacacggtcacagatcgagcgactgcttttttataaattagtagatggtagagaaaatcttatttaacggtgaatttctaaatgcgtttgcttcctctcgataactttgttacgaagtttatgttatagaaaaaagtttcgggaaagaatagcctgtatcacacctcaagcgtgtctgttgcctttgaaggcacttttggaaaacagttcattcaaaatgacggtaacatccgtttcaagcaaagaataatcctgtgaattttcttttctgtcatatcagttgtattccgtttttcaaggcttcctgcactaccggtgaatcctcatggtcaccgatgacgtcaatcttttggtcgcccaaatgcagtttcaagcgtgcggtcatgcgaatgcgtgccaatacccccttcttttctcccgtgctgcggactaataaatcaatatctcctccgcgcttttcgtcattcagacgggaaccgaagagatatacctgcactgtttcaccataaatatctttggctatttggatgatggtctgtatttctttagattgcaaacgcatgcctttattctcctttcttaccgcaaagctacaaattccccttcacatttcctagcgtccgccatccttattttatcttctccacaaaccccaccggcatatcaacccccgcacatcccagcaaatccagtcttaccaccactttcgcttttccatccatttccaccagttctccttccagcccctttagcggacctttgaccacccgtatcaattctcccggagccaatggcgcggtacacatctccaccgcctcgtccgaataatccagcataaatttgaaccgttccatctgttcgtccggaatcaccgccggagtatgttcgccatgcagcaccatataccggctgatggccgacaacgtgagcacctgcgaacgttccgccgcatctacatggacaaaaatcatcatggggataaccacccgttttattttctttttccggtaagtccattggcggatttcttcttgtacaggcaggaagttctctatgttcattgcggtcagccgttcggccgtcttcttttcgtggtgaaggcggacatacgccactagccattttttcatattcggaggaaggaaaagtaatgttagatgttctaaaaaatgaaagaaatgatgcctcttgagcacgctacgctgttacctgtgtcattcccaggtaagcttgtcgttaaattctgatgcaaatatagacatttttttacgataacaagctatttgttcgcaaaaaatgaaaaaattaacaagaatgacgtatttatttatacttttgtgctttttatattttaaatgatattaacattgtggaaaaatcaagatttataagaaaaatagtggcagattgagcttccttcaagagttggaaaaaatcatggccggatatcgcctgtccggtgaaggctacactgatgaggaaatgagagttctgaagcgcatgtgcaaaagtatgttggctgatatagacgagtttctgcggaaaaaggaggaaaagaagaagaaagaacggaaagagaagaaaaagaggaaagaaaggaaataaggagcaaaatgtgaaaagacattaaaaggaagtctcccggttatttgtacacttgtatcataaatgggtattgtaaatcagtgctttacgttgggtaagtgtacaattttaacttttgattgtatgggtttgcaatatacttttgctttcatggtggagggaaatgccctccttttgataatttaaattcatacatgaatggtttataccgatttatgctctttctatttctcggtgttcgatgaacatgccgtggatatgacattgaaagagtttgtgaaacttctgcgtggcgaacgctggaaggtgcaagtagaagagtatcagcgcctgaaggcttcgggcagggagacagaggccaagaagttaaagagaaaactggccgcgctggtgatagccgggcgttgcgatgggagccatgccgaaaccaatctgaagcagtggagcggggacgccatgctggatgtggataaatgtaacggccgtgtgtctgagttcttgcaggtattgaaggacactccttgggtgaaggcggcatggcgcagcgtttcgtacgacgggctgaaactggtggtgcgtgtggaagcggagagtgtggacgagtatcgtatggcatacgcattggtggcatggcacgtggcgcagcttcttgcctttccctgtgacatgagttgcaagaatcccacccgtccttgctttgcatcgtatgatccggaggctttttttcgtccggataccgaagtttttccctggcggcgctttgtgacggagcatcccgacagggtgggggagattctggcggaactgaaagtgaagaccccggcaggtgcgtccgggcctcccgttgcggcttcgggcatgctgcacacattcttcaacgagttcctggagcagaatccctttgtggatggcaaaaagaatgagtttttgttgaagctgggacgtatcgcccgctataaaggagtgggcgaggaagagttggcacggctgaaaacgctggcggtggaaaggctggcgggtatggggtgtgccgccggggatatacctccgcgcatagactccggataccggtatgccgacatgaacaaggggcccgaaacacctgcttccagggctcacaaggctcagggctcacctatgcggtattctgagcccaatgagggggaggaagaggctgagttagagaaacttgaggctgacaagttgcgtcgtgaagttccgtgtcttccggatgaactgttcgaccgtttgcccgactttttgaagcgtggtttgacgcacgtccgcaacaagcgcgagagggatattctgttgctctccatgattaccaacatcagcggttgtctgccgggggtgaggatgaattatggaggaatggtttattcctccgatctctacctggtggctttggctggttcgggcagaggaaagggggtgatgcaactggcggcaattctgcccgcagccattcaggagtattacgatgaattgaacaggaaggatgagcgtgagtaccggcagaagctgctgaagtggaatctggaggaacggcttgccgctcaggaaaagagggttcccgatttggaccaatgcccggagatgccggtggaacgcatcctgaaggtggctcccaatatttcaaaaagccagttgatactggctttggaggcgggtggagcggtcggcttggtgatgaatgcctccgagctggacatgataagttctgccatgcaccaggagtatggaaaacatgatgatgtgatgcgtgccgcctcccagcacgaggaggtgtcttcttatttcaagacggatcaccggcttgttgttgtgagtgaccctcatctggcattatgcgcttcgggtactcccgcccagttgcataaatttatttcttcgctggagaatggaatgtacagccgtgtggctttctatgtgggacaggcccactgggagtataagtcggcaaatcccggcaaggcccggctggatatgcgcgcttatttcaaagggatgggcgaggagctgctgcgtatgtttatctttctctccggatcgcctaccgaggtggttttcaccgaggaacaatggaaagagcatacggagcgtttcagaacgtatctgcgtgaggtagtggcggaagatgatgattctccgggtgccattgtgctgcgccacggactgatgatgtctcgtattgccatggtgctgactgcattgcgtaagtgtgagccgcaatggaatacatcggagtgggagtgttcggatgaggatttccatacggcaatgcagatagtggatgtgttgctggaacacagtttgctgctttccacttccatggatgatactgccggaagaatcaggccggtaaaggcttttttcaaactgcgtcccgttttgaaaaaaatgccgcgcgagttcacctattcggagctgatggcggctgccaatgaagccgggttgcctacagcatccgtgaaacgttatttgttgcgtttggtgtattatcaaatcgttgagaaagaggatggtaagtatagaaagaccggcaaatcttggctcagaaaaccgcctaagtgagccctgagccttgtgagccttaaatgcaggtgaaaaagatcctgttgttttcaaaaaacaacaggacctttccggtaaaacaacaggggattttaaaaaaacaacaaggtctttcgatgtagacaacaggttctttgggaagcgtatgtcctaaggttctcccagatgcctcactatgattgccacttcatgcttcagaaagctgtggcggaatttgttgtagcccgcttcgttcaattcttcctgtagcagcatgtttctccgcatccagcgatacagggtttgcagggctgccgcggcggtccgtccggggctgtatagttctgccagttccgctttgtcatacgctctgataatgaatgctttttcttcttggttcatgttctttatcgttttgattatagggtaaagatacgcaaaatgtccttgttttcctactctctctgtaagttattctcgacatttcccgacaatctcctacgcttctctacaaatgtctacacggggcttccggttcatcgtatctttgtagtgtaatcaaaagtcaatcatagccggcttagtggttaacgcttgattgccagtgtgtttcttaatttgcaagttttaatttttaatttgaaaaagtatgggaagaacagtttcttattcggtagtaaagcgtaataatccgcttgatcaggacgcgttgcctaagttctatgcacaagctcaggccaatggccatgtagagattcgcgaaatggcggatcgtattcagaaaacctgtacggtgacgcgtgcggatgtaatggctgtgcttgttgccttggaggatgtgattatggaggctctggaagggggcgagatcgtaaggcttgccgatctgggcactttccagataggtctgagcggaagaggtgcggaaacggaggatgcgtatgatgtgtcgatgattagaaaagcgcgtatcaatttccgtccgggtattgcgctaagcggtattctggcagcactgaaatatacgaaggtggataaattgccggtgaaaacgaaggaagagcaaaagcctgcttaagtagatggcggacaagtgtttaattttaaaaaaactgtaggatgaaaggtaaatctgtttggagcactattttgaaagtggtgattgcagtagctacggctattgcgggtgtagtaggaatcagctcgtgcatagggggatgagggtgattaatctgattgttgtccactgttccgccacaaaggcggacagggactttaccgaacaggatttggaggtgtgccaccgcaggcgtggaatgaacggacccggatatcatttttatatccgcaagaacggggatataaaaacaacccgtcccatagagaaaatcggggcgcatgcgcgtgggtataatgcacagagtatcgggatatgctatgaggggggaatcagtgagcggggcaggccggaggatacgcggacggtgtggcagaaacattcgttgcgtgtactggtcaggacgttgctggtggattatcccggttgcaaggtttgcggtcatcgggatttaagtccggatttgaacggaaatggcgagatagagcctgaggaatgggtgaaacagtgtccctgttttgatgtttcgaaagaaaaatatagtaaataatatttatatattaaaacgtaataagactaattctcttctgaatttgttaaaatgttaacatttcagaaagaggattagtcttatgttattatgtaattacttttgaaattactttttgtttacattttcattgccatatccatagccgtaaccgtattttttaccgtatccgtaatacttgccatacttgccgtatccatagtaatatccgtacttctttttcttcatgtccagtccgttgataagggtacataggttgggcagttttttctgttcgctcagttcgttgattaaagtataatctgccttgtgggtgtagtctgcccggcacacatagatgctggcgttggctacgcgcgaaatcagttgggtgtcggtcaccatgccgatgggggcggtatccagaatgatatagtcaaaatgctttttcagtatgtcgatagcttgagacaaagattcacgtgccaccagttcggtcgggttgggagggataggacctccgggcagaatggacaagttggaattgatgtttgaaacttgtaccaatgacatcaggtcggtatgttccggattggcgaggaactggctgatgccttgttccttgtgtgataactggaaggctttgttcaagcccggcttgcggatgtcaagtcccacaatcacgattttctttcctaataaagccagactgacagccagattggaagcgataaaggttttgccttctcctgtggcggtggaggtaaccaatatgactttctcgtcgctcctcatcatataaagtacattggtgcgtacattacggaaggtttcggccatcaggtcgttttggttttcgtgtactacaatgctttcttcttttcctttatcttccgacaggggtacatcgcccacaatgggaagggaggtgattttttccacatcggcgcggccctctatcttgtattttaagagttcgatgatatagatgacaactaccggcagggcgattcccagaatcagtgctaccagataaatcatcttccctttgggagatacggggatggcatctgccagtgcttcgtccaccatgcgggcgttgttggcggtagatgccagagtgatggcgttttcttcacgcttttgcagcagcatcaggtaaaggccggctttgatttcctgctggcgcgagatgctgaccagctggcgttcctgtcccggagcattggtgatgcgtccggcatatttgcctgcctgacgttccagatccgcctgggtgatggccaaacctctttgtacgctgttgatggtggtcagcacattgctgcgcatggcgcggatgctggcatccagattgactaccaccgggttgttttcctgagaggagcggagcaggcgcttgcgttccagcagcatctcgttgtagcggttgatcagttcggtcagtccggtatctgtcaggcccacattgaccggaagtacttcgtaggcatgatccggattgttggcatagccggccaggaattgtaccaaccggagctgggtgctgttttcggcacgtttcttttcgtattctgagttttcactcaatgccagttgggcatcgcttttcaagtcggtgagtccggcatcgcgcttgaaggtttccagttcctgttccgtggttcccagttcgccgttgatgattttgatacgttcatcaataaattccgcggtcttggtagccacttcgtttttgtcatcgttggcatcccggttgtagacttccaccagcttgttgatgaaatccatgccgcgctgcgtatgcgtgctcttgacagagatctgtgcgatagtggtggatttggaagtaggctctatgctcaatgctccccggtaagtgtttgccacactgcggggggaagaaaccgtagccatgatttcctgcgtgctttggacggttgtggaatctttaggggtaaagctgaacgtgcccgacggggtggtcagcaaggcgggcagcttgtcgaactgcttgttgtattcctcttctcctatccggagtttcacattcagcttgttgcccggctgcaaggtcaggtgaagacgcgcgggggcgggcagtttctgggcttcttcgggggtaatccatactttcacaggggaacttttgtaaagttcgatgtcatggaaactgctctttgtggcatagctgatgtaaagatccagctcttccaccacttttttgataagcgtgcgtgattgcaggatttccacttcattgtcaaagttattgatggaggagtagaagcccaggtcttccaggtcggccatgccgctgcttgctttgctgttcttgtcattgtccttgatgatgacggatgccgagatgttgtacaccggcggggtgtaacgcaaataaagccaggctcctgctatgcacagcagggtgcatgccacgaaccagggccaatggatggcgtatttgaaaagaatcgctttgaaatcggtcttttcttctttttcttccagataaaggtcgtcgtataagtcttctttcataattctgtttatttggcaatggttactatcaggctggccagtgcgaccagagttcctactaccgagaaccagatggtggtgctgttgctgatacttgcgttcttggctttggtcttattgggggtgacatacaccacatcgttctgctggaggtagtagtaaggagatacgatgatgtcggcatcgttcaggttcagcggaatcacctggcggttgccttgcgcatcttcacggatcagtttcactttgtcgcgttgtccgtatacggtcatgtctcccgccatggcgagcgcttccatgatgtttactttttcattggtgatggtgaatgtgccggggtgtgctacttctcccatcacggagattttgtagtttgccatgcgtacattcacaatggggttttccttgatataggttttcagtttttcctttatcatgttttccgcctggcttttggtgagaccgccgatgtgcagtgtgcccaagaccgggaaatcaatgttcccgttattgtctaccagatattgttgcagggatggttggctggtaaggcttttgctgtttgccgtgatgggggtggctaccgtcaggttaaaaggaatggcggcatcgggatcactggtgttcaccgtgatggtcagcaaatctttgggcatgatgtgtgcatcatacaggggtgtttggacatttgccatgttcaggtactcggacccttgcaggtagggtacctttttgtaggcgctgcaactgcatagcagcagggaagccagcgcgaatagggtaaatttcaatcttctcattttttggctctctgttatttaaaaaatttcagttttcaggtcttgttctaataagcttgcttgtctttgtgcagcacgtttgccacggttttgtacataatataaaggtcgagcaggaaagaccagtgttccatataccatatatcggctttcacacgtccttccatgtcttccagttcgcgggtttcgccacggaaaccggtcacctgcgcccatcccgtgataccgggcttgatgaaatggcggaccatgtatttattgattatcttggaatattcttccgtgtgtttcaacatgtgggggcgtggccctacaatggacatatctcccagcaatacattgatgaattgcggaagttcgtcaatattggtccggcgcatgaaatcgccgaatttggttttcctgggatcgttgagggtggcctgtaaggtgtccgattccttgtttactttcatggaacggaatttataacaccagaattccttgttgttcaatccgttacgtttctgacggaagaatatgggacccgaagaagtgattttgatggtcactcctacaataaggaatataatggggaataatgtgcataaaaagagcagcgagaagattacatcgaatatgcgttttatcagcctgttctctatttttcccaagggttccttgcggatgctgaggatgggtacgctgcctatcatttcaaagtgcatgcggtgacgcaggtagttgcgcacattgggcacgctgtagaaatgtatcaggttgttctcgcaatagttgatgaccggcacgatctgttcgctcaatgccgggggcaggcagcagtaaagctggttcaccttgtgttgtgccaggtagtcaatggcttgctccggttttcccagataggtacagctggcggggaacttggcattgggggtggtgtcgaagtagcccagtacccggtagccggtagtggcatcggaggtcatttcatggtacagctcggctatattttcagtacttcccaaatagaggaccgtacggaaatttcctccatggcttctgtatagctgtatgcagaaacggaaaagcaggcgatagacagtgatacagaggatgagcagaatgaaataatagataaaaaagcgtttggaatatatctcaagttcggataataccatcagtccggtcgataaaaaagagaaatagaacacgttgcggagtacccggaatacaatttggtcggcacgggctccccgacgatgcagtatgacacctcctgaaatagtgcatgcaaaataacatacgctgaacagagttagaatttggggtaaagtgccgctacaggctctttccccaaacaactcgttccatattgaattaaatgagatgaaaagtacattcagaatgactaaatctcctagaatgactgctaatttaagtactttgttaaatctctggacttgtatcataggtaaaactttttatatgtcagatctatatgatgtttttttcaactatgtttcaactatgtcgctttttttcttttttctgctcttctgttactttgtaagtaacagaaaatttatcaataaacatattgtataatttatatctcactattttatagcggataagatataatattctgaaatataatattttaatgcattgcgttgactgtgtaaaacgtgatgtgtgttactatattttctcttttttatataattaaaaatgttctttttattattactttttatctattagaccgtcttttttattaatttttaaaaaaaagaagcgggttgtttcttgtttgctatcgatttattgtctatttttgctgccgaataaattctgttacttacaaagtaacggaatttaaatagcttgataatcaactttttatctattcatgcccttttctttccattttttgaaacgtatagaattattgcatcattagctttttttatctcttcatatttgaagtttttcaaatatgtttctgtaactttcactgacgaatgtccaaaagcctcacagattagttgttcagagaaattacaatatttggcaagggtggcccaggtatggcgcgtggtgtatgaactgaccttggttatcactccacatcgtcttgccagtctgcccagattataattcatgatccgtagcgcctgctgatactctatatacagctcttctccggttttggtgccgctcaggatagggaaaagatagggagagttgcagtcggtattctgatattgtctgatcagttccattgctgttggcggaatatccactatcatttggccgcctgttttatgccggcggtaagaaagtgtgttacctttcaagtcacttttgtgaagaaaggccagatcaacaaaaggcatcccgcgcagttggaacatcaggtttgcccaaaccctgcatcgtaccaggtcttccggtagtcttttcagaggaacttcgttcagcagcttgtttatctcctccacttccagcgcacgcttgacatcgtttttcactccggtatagacgtgattgaataggcgaggttttccagtggttattttctggtccaccgctttgttgtaggcgccgcgcagtgtccgcatataggtggaaacggtgttccagctcagctgcttgtcgcgcaggtgggtctcaaattctttcagtgtggctctgttgagctggtggaagtaaacaatcttgcatccgcagaattcgcagaaagcgttcaaggtactttgatagacatgtgccgtgccatatcgtttctcgtctttcagttcttcaatcgttttgttcataaactcgttgaatttttttttatttctcataaggttccgtattatagattttacataataagtaattttcataacggaatcgaatatagactgaaatgttcaaaacagaaagattatttatctaattctgcatcatttatacgtattatccagccgtttacttgcatttgtaaacatatgtaaggtttctgcggatcctctgtcgggctcaggaaaaatatcaggttatagcggtcttgcctgtcaagatattcttgtggaggcatgtaggttgtttcgacattacgcgacagaagcagatagggtgtcagcggaatatcgaaaatctcttttccactaggttgatagattaaccgtaggcgggtgtcgtcattctccatcagtctcaatgtattcattccggcatgtactacctgtatgtcttccagattggcgctttcctgcatgaagggaagatagcaggtgaaaacggagtctgtcggagtgttccggtgatccatgcatccgttgcgggctgtcagctccagacggaaatcatctgtatccagaggggcggccgactggctttgcaatatgcagctcagaatattcgtgtttttagtaagagagagagccaaaacctgatattcgccgctgatatgcacgttgtccagccgcccgtggaatagagatgaaagtttttcggattgttctcccgcttcattgcgtaacagtgtcagtgaagtgggagtatgccggtaaagtgagtctgccaatcctgcccagaccagaaaggtgtaatctccctgaggcagggaggggacttggattgtacattcattttgatggaatgtaagactgtctacttcctcccggactatatagtttccttcctgatcgagaataaatagcgtgacatcttttacctgagtggtcacggcatctacattcagcatgttataggtataggataactttagccaacagcctgtggggcaatcggattggtcatcgtctacccaggaacatgcactacagaaaagagtacatagggcgaagaggatagtagcagttttactcattgtttttctattttgagactgttttattcaaggtcggcatcttggtcacggacaatccacggatatactccgaattctacgtccaggaatgctttgttttcatccggatcgggtttggtgtccggagtgccgggacccaggttcttgatgctggtgatgttgacagagtagatgttgttacgtacaataccgaattccatgacgcccatgacggtggggttgttgttgtcaagatgtttgatccagtaattgtagaaggtagagaaattacctccgttcttggtgaaacgggtaatctgcttggttgccagttctgcatcactggattcttctgtcaaaccatcaatattggcatcgccatatttgcctacagctgccagtgtggtgtagaacttatagttgaaataatacagtgtgttgaatacaagcgggtcttctaccggattaccgttgttactgatggtctgtgaagcttcgggggtaaatgtacctttcagcatgataccggtggtgtacactgtgttctgtgccggacggaacatacagttttcaagacagtacatggaaacgtactttcctgcatcggccaggcccgaccagttgctgtctgtctgttttgacaggtggttggtgtagaatgaaccgcctgtgaaattggtagtggctcctgctacggtcttgtcgaagaaataggggtcgataaggtaaccgttgttgtcggcgatgttaccgaagtttcctgcttccacgctgtaagatgacggagctgacggagtctcaggggcgttatccagtgtagcgacatgacggaaggtgtagaacttgtttgccaggttgatgaatttgtagttgttcagacggactgtggcgtaagtcactccggcagaattcttcaacgtgtagatttccttgctgtcatttctgaccatcagtttggcaacggcacgttccagattgattctgacgtgtgctttggtgtcgctttcttcgggagactccacggtgatgttcatattggccgagccgcggttggacatgatgaaaccgcttccgggtacgctggttatcatgccgtttccataggtggaggcgtcaatctgtcccaataatgtggattcctgacctatttcgaaggtctgtgaaccgttggctacggcaaggatgtcatagttgcccggttttactgtgatttccttgttgcaaggatagacaatggtttgtccttctttgctgctctctccgctggaagtgcctgcacccagatcgctttgagttacattgatggtagtaaccagattcttgctggaggagtcaaacagatagagggttacattgctcaccttgtattcttcggcggttccgtcttcgtaaactccggagtcttcggcggaagcggcacggctgccgttggaagagttgggaactacaaatgaaatctccatgttccctcctctggctccgggagccggattgtctccgtttcctgagggaacatctgcatcattgatacatcctgtcattgcggctgcaagagcgaaggataataataattttttgttcataatgtaaaatagttttagttaaaaatgtgattagtaaatctcatgtaatatcttcaggttttcacctgcttggggcagtcctgcctcttccgctttgtgcagcaggttctccgcttcggtatagttcccgctcagcatttgcatgataccttgcaaaagggtcttttcgggagtttcaccggctttgtccagatagagtgaggcgcctttggtatctccctgcgcgagcaggatgcaggctgcattgagattggcaacggggtgttccggattaagcagaaccgccgtcatgaaaatcttattgtattccggactgccggcagggtaggtccgggctatgcggaacatctcttcaatactcagattcttggggttgctttggaatacctgcttggcctgctctaccgtaaacggacgtaccacatagtggatggtgtagtctgaatggcggaggccggggaaccaatgttgcaggatgaaacggaactcttcgggataacgtttccgtattttccgttctttcccgtcggggctgcttttgctttctgcaatatgtagcagttcctcgcgatgggtgataacggtgtcggtcagcaacttgacaaatccgtcccagtcttcgggggtgtaatgggtggtgaacaatgtatcattgaaagcatattggctgcatacatagtccttcaaggtccgggtccgttcccgcgccagacgctcgttgttggagtaggggccttcgggagaggcgtatccgtgaatgtcaatatgcgaaatgactacattggtatcgttttttatcaggtcgatactgcgctttatctttgccagttcggccggattgtttctgtattcgggatagatggttgtttcgttgagcgggaagtccagataggcacgtccgctttcttcgcgcactttcctttcttccatctgcggagtgatgaacgctacgtgcggatggatatcgggaaggatgttcaggcgggtcagataggtggagtctgtatggcggggaactccgcatccgcattctttttcgatgagatgcaaggaggcatgcttcatccagtgggtgaaggggatgctgcgcaagtagtgtacgctttgtttgcggtcattgcggcggcgtaactcttcatagtctttttcctgtctgccggtttcacgctggaagaaaatatgctgtttacgaccgttcacatagatggcgggaagctggatgaagttgtccaggctgtcgctgagccggggaaccagtatgactgattcgttggagggaatctgtctggtaatgtctacctgcatggacactaccagactttctcccatccggtagagccgggaggaggcgatgtaaatcgaactgtcccgttctgccggctgcgccgatgagcaaagcgcgggaaaaataaatgatataagatagaataagtatttcatggctctttagttaaatatgtaaactatactcagggatgctttggaggggccgaaatagtgataatggcctttttccagtagctcggcacacacgtcggggcatttatatttcttatagtcgatatattcataccctacaccgacggaaacttctatattccagtggcggttgagcaggatgtggtatccgtagcttatgcctccacctgccagccagcctgcataccggtgctctttcagccaggggaagagtccgaaaggcatcttttttcctcctacgttgaactgcgctccgttgagataggctccccaaaaactgccgttgaatttctggcaagtccagtagcggtattccggttgtatgagccaatatttgttgacatatccttccgtgcgtttccacgggcgtatgctgccggacaaatcgaatgtggatttggggccgaaggcatattccacaccggcattcagcgcaccgttggcggcggaaagcaggttgcttttgacagccgttttctgtgcggaaacggaaagggcgctgccgagcagaagacaagaaaggacataccgggttttcatgttttattgtatattggtttggttggattcaaagaatatttttaggttataggtggcttcttccgagccttcggctttggcggctttcagcaggcggatgccttcgtaggtgttgttgcacaacagctcgtaggctccacggcagttcttgtaggcaagcgtttcatgggaagccatttgcagatagcggccggctgcctgtgtgttgccccgttcgatggcggcggcagcggcgttgaggttggcaacggggcttgccggatatatcttgacacagatgtctatgattttgtagaactgttccggagtgttcttgtagctgatggctacggtgtaaagctcgcgtaacgaaagcatctgcggattgatttcggctatgacacgcgcttcgtccagactgaagttcagctctttctggttgcgctcatcggtggcatcgctttcgggagatacatagcttcccttgaaatacggtttggcggagggtgcggacggagcaggggaaacaggacggtgttccggaacaacgggggcagagggggaggaggctgccataggagcttcccggttcctgtcccgttggggaacgaaatgatctgttgctgttgctatatggggtgctgtgtccggaatggggatattttcgctttgtactttctctccgctgccgttgatgacttccttcttgaggttcagggtggcgaactgtatccagtcggctgccggaagggaagcacggtagtggatagtctgatcgctgtctgtcagggggatagcggtaaatacgggagttacatctgccttgcctcttcgtttgttgagcgccagggtacggcggtatagccggtgtgcacgttctccgttgagcaggatttgagggagttctgccgtgcgggttccgtctgtgaggacaggagtgaggcggatatggtttttggtgtccatttggggaacattgaaggtcattttcatggacactgtggcagagtcctgtccgagagtaacggaaggaggcaggatatcgagtttcaggttttgtgcagtggcaaaggtgccgcataataaaagactgaatagtatgtttgtcttgagtttcatgactgatagggtatatttgcttttatatttattgaatgaaataaatgaatgatatgcctagctgggtaggtccgacatagttggagtgggatttctcaatgagtgcgtctcctttggcgggaccgtatttatcataggtgagatgggcgtatccgacagatatgcttgcttcaagactccagaatgtgctgagcagccattggtgtccataggtaacgccgcaacctatcagattaccctgataacggttgttcttgaccgtggtgaaaggagtggttccaccgaaattgtattgggcgaaatgggcttgcaccccgaaaaaacttcctatgaatgtttcattgagccaccaacggtattcgggctggatcagaatgtgcttcatttttttgttttctcccagattccagggattatagttgacactcagattgaatgaatgggtgtcgtcacaccttatttctcctccaaggttgagagtgccggtaaggtcataaagaacattgctttttacagcgatactttgagccggggctatacgcggagtcataactgctagcatgattgctattataaataagtaagaatgtcgcattgtcaatatttttgttttgtttttttctgttactttagaagtaacggaaggggaggagggaggcgaaaaaacatgaaaacagcagtaagataaagatttagtggctgttagagaagataaaagaccggaaatgtggcttcactcatattgacaatcggagtatgggtagggagaggtatatgcggaataaaaaaaaattttaaaataaaaacgaaaaaaaagtgtagaaatcttgcactgtatttaaagtttgtatacttttgcttccaaaatctgttccgttacttctaaagtaacagtcttttaatttgttgttttataatgtaatgtgaagttttaaaattgattatatagaaatactaatgtgattaattattactttatttgctctgtctaattcatcgtttttaaagcttttcaaataggtttcggtcacctttgtggaggagtgccccagggcatcacaaatcaattgttccgaaaagtgacagtatttagccaaagtggcccaagtgtggcggctggtgtaggaactgacgttgagtttgattccgcagtataccgccagttgtttcaggtcatagttcagtttccgcaaggcatgttggtattctgcatactcttcttcgcttttccggtttccactgagaatgggaagcaggtagggggaggcggagtctgtattttgataccgtttgataaggttcatggcagcgggaggaatctcgacggtgagcagggctcctgttttgtggcggcggtaggagataacggaatcttgcaggtctgttttgcgtaggtgtgccagatccacaaagggcattccgcgtaacaggaacatcagggtaatccatgcccggctctctttcatgctttgcggcagggggcgtggaagggaggcgcttaataatttgctcatgtctttggcatcgagggcacgtttggtattggcttttacgccggtatatacgtgacggaaaagacggggcttttcttccgccagaccatcgtccacggctttgttgtagatgcttcgcaaggtacgcatataagtggagacggtgttccaggtgcatcccttgttgcgcaggtggttctcaaattgtttcaggcgtgaacgttccatctggttgaaccggatggcatcggtcttgcagaagagcatgaaggcgttcagggtgctttggtagatgtgggcggtactgaaacgctcttcttcttttagcgaccggataagttgtttcataaatagggtcaggttagatttctttttcattgttcttttcgtttttaatgttaggtaattctgttccacaatacatttccgtttaaaagttgagtttgcccccgtttgttcatcagctttttttctttttgtgatagcttgtgctttttcttcgctttttgacgattggcggaggtcttgtgagtacgtcttgttgtttttttcgtctaactgtaaataatttatatgaaaagaatgaaaaatatcaggctaggaacacttgtcgcatgtatgtgcgtgttatgggggtgcgagaaacccaatgtgaatattgtgatgccgcaggaggcgtcgaaccgggtgctgtttgcaggagaacatttgaagaaagcgctggaagatgcggggtattcgtctgttatgttgtcggatactgccggtatggataaagatgaggtatgcatccgtctggaacaggctgctgatacagccggactgaaaaaggaggggtttaccatttctacccgtggaaacatgactacagtgacaggaaacgacggaagcggtgtgatttacggctgtcgggaattgatagatcatgtagggcaatacaaggatttgaagtttccggcacaactgacggatgctccggaaatggtgcttcgcggaggttgtgtagggattcagaaaatggaatacctgcccggaagaggggtgtatgagtatccttatacgccggagagcttcccttggttttatgacaaggagcaatggataaagtatctggatatgctggtggagaaccgcatgaattccttgtatctgtggaacgggcatccgtttgcttccttggtgaagctggaagagtatccttttgccgtagaggtggatgaggaaactttcaagaaaaatgaggaaatgttctcgttcctgactgctgaagcggacaaacgcggtatctttgtgatccagatgttttataatatattgttaagcaagccttttgccgagcattacgggttgaaaacacaggatcgtaaccgtcccattactccgctggtcagtgattatacgcgtaagtcggtggccgcgtttatagaaaaatatcccaatgtaggtctgctggtttgtttgggcgaggctatggatacctacgaggatgatgtggagtggttcaccaaaaccattattccgggagtgaaggacggactgaacgcattggggcgtacagacgaaccgcccattttgctgcgtgcgcacgatacggactgcaagatggtgatggatgcggcactgccgttatacaagaacctctataccatgcataaatacaatggtgagtcactgactacttacgaaccgcgcggtccttggtccaagatacactcggacttgagtgccttgggaagtattcatatcagtaatgtgcatattctggcaaacttggaaccgtggcgttggggatctcccgactttgtacagaaggcggtgaatgccatgcacaatgtacatggagccaatgccctgcatctgtatccgcaggcttcttattgggactggccgtacacggcggacaaactggcggatggcaaacgggagtatcagctggaccgtgactggatatggtacaagacgtggggacgctatgcatggaactgtcatcgggaccgttcatccgaagtggaatattgggacaagcagttgggcgatttttatggtacgactcctgccgaagccggagatattctggaggcatacgagcagagtggagagattgctccgaagttgctccgccgtttcggtatcacggaaggtaaccggcagactttgttgctgggtatgtttatgagtcagttggtgaatccttataaatatactatctatccgggattttatgagagttgcgggccggaaggtgagaagctgatagaatatgtggaaaaagaatggaaaaaacagccgcatgtgggcgaattgccgctggatattgtggcgcaggtggtggaacacggtgacaaggcggtggcggctattgacaaggctgccgcagcggtgactcgtaataaagaggagttcggacgtttgcagaatgacatgcattgctatcgtgaatttgcttatgcctttaacctgaaagtgaaagctgctcagcgtgtcttgaactatcagtggggaaaggatctgaatgaactggatgccgctattccattgatggaacaaagtctggagcattaccgcaagctggtggcattgacggatagtacttattattatgccaacagtatgcagaccgcgcaacgccgtattcctatcggtggtgacggtggcaagaacaagacctggaaagagatgctggtgcattatgaaaatgagctggctaatttcaaggcgaacttgcagttgctgaaagatagggcggcaggtaaggtgacggaaagtgcagctgagataaaacctttgtccgccgcaaatgtgaagatcctgaacggactggctccggtgaaactggcgacgggggcaagcctgttctccaatgtaccgggcaaggtggatgcactggccgccgagctggaagggctgactgcttatagaatgaacggggatgtgcagcgcaaggaaggtacgacaatagagtttgaagcggctgctccggtgaatttgttggtaggttatttccgtgatgaccagaagaagtatgcgaaagccccgaaactggaaacggacgcttctgccaatgattacggtcaggcggaaccgaaactgaccaatgccatacgcatagcgggtatgccgctggcgaatgtacacgcttatcattttgaggccggaaagcataccttgttgctgccgaaaggatatacgatggtgctgggatttacagacgcgcaggtgactccgcgtaatgcgggactggccggtgcggaggaaacgatggactggatgttctattagtagccttaattccagaggccggaatcgcagtatggcgtaaaattttcaagtatatcttgagaattttacgccatttttgtacatagttctaagatttttataaggaaaagttgcttaactgataaactttttctatttttgtcgtatgagcagaaagataatagcatacgaaaactactataaagatttttttgatactctggataaaggtacgcaagaaaaagtcctatatggattactcttattgaagactcaagatagactaccggcaaagtatgtgaagtttcttaaagagggtctgtatgagttaagaatagagtggcaaggtaatatctataggattttcttctgttatgatgaagggcatattgttatattgttcaatggctttcaaaagaagacgcagaaaacaccagatagagaaattgataaagcattaaaactaaagaaagaatattatgagcgaaaaagaactaaagatgtttgatgtcgatgcacagttggatgctgtgtttggcaaagaagggactccggagcgtaaggctgccgaagacagggctaatgctttctttaccgggcaaataattgaagaggcaaggaagaaagcaaatatgacacaggcggaacttgccgaaaagatagggactaataagtcttatatttcccgtgtggaaacaggaaaaacagagcctaaggtttctaccttttatcgtattgcttctgctttgggattgaatgttgagctgacccctgctatgtgatggtaagaatagagaatgagataaaagttctctgaatgggtacattttcttcttttatccgtcttgccaatagataaaaaagataattatgaagaagatattgatattggcatttttactgttgtcattgggaacatacgctcaacgtgaagttccgcaatcgcgcatggagcagatttatgaggaagccaagactccttataaatatgggctggctgtagctcctgccgacaacaagcataaaatagactgccctaccgtgttccgcgaaggggataagtggtatatgacctacgtggtttataatggtaagagcggactggacgggcgtggatacgagacatggatagccgaaagtgataatctgttggaatggcgtacattgggacgtgtcttgtcttatcgtgacggattctgggattgcaaccagcgtggtggttttcctgcattgccggatatggagtggggaggaagctatgccctgcagacgtataaaggcaagcattggatgacttatctgggtggggaagggaccggatatgaatcggtgaacaagccgctgtatatcggtttggcctggacagaccggcctttgggttccgcccatgagtggcaggcacaggacaagcctgtgatgagtatccatgataaagacgcgcaatggtgggaaaagctgacccagtacaaaagtgtggtctattgggataaggagaaaacactgggtgctcctttcgtcatgttctataacgcggcaggacggcatccggaaacggatttgaaagcggaacgggtgggtatcgccttgtcaaaggatatgaagaagtggaaacgatatccgggcaatccggtctttgcacacgaagcggacggaaccatcacgggggatgcgcatatccagaaaatgggcgatgtgtatgtcatgttctacttctcggcttttgaaccgagccgcaaatacaaggcattcaatacctttgctgccagttatgacctggtgcactggaccgattggaaaggagcggatttgattatcccttccaaagactatgatgaattgttcgctcataaaagttatgtggtgaaacacaatggggtggtgtatcatttttattgtgccgtgaatgacgcggaacaacgtggtatagccattgctaccagcaagccgatgggacgttcgcaagtgcatttcccggaacgggaggtgaagaaccgccggatggtgatggaactggataaaggatggaaaacatggctttgtgataaaagtgcatacgggcaggcggacaatgcccctacagtggtagatatccctcataactgggacgattattacggttaccgccaactgacgcatggcaatcttcacggtactgccatgtacgaaaagatattcacgctggataattctctatttccaatttccgattcttcattcggaaaacgttatttccttcgttttgagggagtgggaacgtatgccactgttacattgaatggaaaggatttcggccgtcatcccgtagggcgtactacgttgacactggatgtgacggaggcgttgaagccgggagagaacagactggtggtgaaagcggagcatcctgaaatgatagccgatatgccttgggtatgcggtggttgttcttcggaatggggattcagtgaaggttcccagcctttgggcattttccgtcccgtggtgctggaggctacggatgaaatacgcatcgaacctttcggagtgcatatctggaatgatgataaggcgggaactgtctttgtagaaacggaagtgaaaaattacgggaagactgccgaaacggtggaagtggttaataaattcagtaatgcggatggcaagcaggtgttccgcctgacggagaaggtgactttgcagccgggtgaaaggaaagtggtgaagcaacaatcgccggtgcagaatcctgtcttatggagtacggagaatccttatttgtataaactggccagtatgataaagcgtggcaagagtacgacggatgagattagtacgccctttggtatccgtaccgtcagttggccggtgaaacggaaggacggtgacggacggttctatttgaacggacagcctgtctttatcaatggggtatgtgaatatgaacaccagttcggacaaagtcatgctttcagccgtgagcaggtggcagcccgtgtgaaacagatccgtgcggcgggcttcaacgctttccgtgacgctcaccagccccatcacctggattatcagaaatattgggataaggaaggggtcttgtggtggactcagttctcggcccatgtatggtatgatactccggagtttcgtgagaatttcaagaaactgcttcgccaatgggtgaaggaacgccgcaactcgcccagtgtggtgatgtggggattgcagaacgaaagcacgctgcctaaggagtttgccgaggagtgtagtgagattatccgtgaaatggatcctacggcgcgtaccatgcgtgtgattaccacgtgtaacggtggtgatggaacagattggaatgttattcagaactggagtggaacctatggtggtgatgtgaataagtatggccgtgaattgtcacagaagaatcagttgttgaacggtgaatatggggcatggcgcagcatcgggttgcatacggaaccggcagcttttgatgcgaacggcgtatggagcgaggaacgtatgtgccggttgatggaaaccaagatccgattggcggaacaggcaaaggacagtgtgtgcggacaattccaatggatattcagcagtcatgataatccgggacgccgccagccggatgaagcgtatcgccggatagataaggtgggaccgtttaattataaaggactggttactccgtgggaagaaccgctggatgtatattatatgtatcgtgccaactatgtgccggcttccgaagatccgatggtctatctggcatcccacacgtgggaagaccgttttgcaacaggccgcagacgggctaccattgaggcgtacagcaattgtgacagtgtgttgctgtacaatgatgcggtggatgctgaatacttgggacggaaactgaatcatggggtaggtactcattttatgtgggagaaccgcgacatccgttacaatgtgattcgtgccgtgggatactttaaaggaaaaccggcagcggaagatgtgctggtgctggacggtttggagaaagcgcctcattttgaggctctttaccgtggctctgttatagtgcctgttgctgccgaccggttgaacggaactgatttgttgaaaggagctgagggatatacgtatctttatcgtttgaattgcgggggagatgcttatacggatacgtatggtcaggtctgggcgcaggataacagccgttattctcattcgtgggcggaatcgtttatccatccgtcggacagtgtgcagttattgagcccttatcaggcgagccagcgtaccacgaatgatcccattcatggcactagggattgggagctgttccagactttccgtttcggacgccataaactgaatttccgctttcccgttccggatggcgagtatcgtgtggaactttattttacagagccctggcatggtacgggaggcggcgtacagacggattgtgaaggcttgcgtatttttgatgtagcggtaaatgataaagtgcttctgaatgacttggatgtatgggctgaagcggggcatgacggtgcttgcaaaaaggtggtgaatgctgttgtgaaaggtggggtcttgaagattgattttccggaggtgaaagcggggcaagctctgatttgtggcattgcgatagcttcggccgcttttgtggagcctgttgctaatcaaggggctgatgaccggaatgtaagtttcagctgggctgcccaggatcaggatgtgatggaaaagactcccaaagaattattgcctgaagataaaaatgcccgtgccaatgtgacttatcaagccgaggacgctatgttgaaaggcaagtttataaagaaagaggtcaagaaacaaaccggtgtcttctttggtaaaggtgagaaaagcagtattacctggaatatctctaccggtctggcacaggtctatgcccttcgttttaaatacatgaacgctacggggaagcctatgaaggtgcgtatgcagttcatcgactccaaaggggtggtactgaaggaggatcatctgacttttgccgaaactcccggaaagtggcgtatgctgagtacaacgacgggtacgtatatcaatgcaggctattataaggtggtgctttccgctccggatatggaggggctggcactggatgcgctggatgtgcaataggaggaatggtttctgcaaatagtaaggggaaagtttcagcatttggcatttttacatatctttgtgctctgaaactaacctcttaaaaatatgttaattgatttactgcattcttcttatttctcgctcttccttattgtagcgttgggttttatgctagggaggattaagataaagggtttgtcgctggatgtgtcggccgttatcttcattgccttgcttttcggacatttcggtgtgatcattcctaaagaattggggaacttcggtctggtgctttttatctttaccatcggtattcaggccggtcccggatttttcgattctttcagaagtaaaggaaagacactgattcttatcactatgcttattatttgctctgcctgtctgacggcggtaggactgaagtatgcttttgacattgatacgcccagtgtggtgggattgatagcaggggcattgaccagtacgcccggtctggcggtagctatagacagtacaaattcaccgttggcttccattgcatacggtattgcttacccgtttggagtgataggggtgattttgtttgtgaagctgttacccaagattatgcgggtggatctggataaagaagcgcgcaggttggaactggaacggcgcagcggttttccggaactgacaacttgcattttcagagtgaccaatcaagcggtattcggacgtactttggcgcaaataaatgcacgtgccatgacgggggccgtcatttcacgggtaaagcatgaggattctatattgatgcctaaagcgaataccatgttgctggaaggggactatgtgcaggcggtgggaagtgaggaagcgctgaatcagtttgccgtattggttggagaacgggaggaaggtgaattgcctctggatcagacacaggagattgaatctttattgctgacaaagaaagatatgataaacaagcaattgggggatctgaatttacaacgtaactttggttgtacggtaacccgtatccgtcgaagcggcatagacttgtcaccttctccggatttggccttgaaattcggtgataagctgatggtggtcggtgaacgggaaggactcagaggcgttgcccgtttgttggggaataatgccaaacagttgtctgatactgatttcttcccgatagctatggggattgtattaggtgtattgttcggcaaaataaatatttcattttcagacagcgtttccttttcacccggattgaccggaggagtgctgatggtggcattgctgctgagtgccgtgggaaagacaggacccatattgtggtctatgtccggtcctgccaatcagttgttacgccagttgggcttattgctgtttttggctgaggtcggtacttctgccggtaagaatctggtggctacttttcaggagagcggattgttattgttcggagtgggggcggccattactgtcgtgcctatgctggttgccgttgtggttggcaggttggtctttaaaatcagtttgttggatttgctgggcaccatcaccggtggtatgaccagtacgcccggtcttgcggcagccgattccatggtagatagtaatattccgagtgttgcatatgctacggtgtatccgattgcaatggtgttccttattttgtttatacaagtgatcgcttcggcggtttattgatatatcaaacagccgggtgggtatgtgccaaaggtagtaaatacttttggcacattttttatttggatgaatgttgtatttttatttatcgatatgaggagaaaaaaatattcattttgtttcttttatagattttaatttatatatttgtcacaaccttaatgtaatacggagaaagattaggcttattcagtgacagaatgacgattggaatatggtatgaataagctgaactcatatatggtatttataaatatactcaattttatgaggaataaagacacacactctcgaattacagacaaatgcagatgtttgtttgtagttgcctattcggcaatgtctattacaggattgagctccgtgctcgcagtggaaaaccatgcactatcttctccggtttcagatcgtgtggaaagcgtacagcagaaaaaacatgtttcaggtaatgtgcaggatgctaacggaatgcctttaatcggggcgtccgtaatcatcaagggaaccaataccggtatgattaccgatattgaaggtaatttcgctcttgatgctaaacagggtgatattatcgtaatcagttacatcggtatgaaatcggcggaggtgaaagtgcctgctaacgggcaaataagagtgatgctgaaagaggattcgcagttgatggatgaagtggtagtgaccggttatggtgattttaagaaggctacttatacggggtctgcttctgttttgaatacggataaattggagtcattgcctgttgtgtctgtagcacagatgatggaggctaatattccggggttaagttcagtggccagttcttcccaaccgggttctaaagctacagtgcgggtgcgtggaattgcttctatgaatgcttctacagaacctctttatgtattggacggcgtgccggtagcgtctagggatatgagtggtctaagtgccaatgccagtgcgggaggacttggtttgatcgagacattaaatcctgcggatattgaaagtataaccgtattgaaagatgccgcttctgcttcattatatggagcaaaaggatctaacggtgtaatccttattactactaaaaaagggaaggaaggtaaaatgagggtgagtatgcaggctacttacggtattacggatattgcttacaattatcgtccgataatggggggtgaagagcgtagggagttgatttatgaaggatttgttaattatcgtttgaatcagggggattcggaagccgaggcaaaggcttatgcggatggacaaattgacaattatgctgcacgcccggccaacggatatgctgattgggaagatgctttattgaaaaaaggacatcagcaggactatagtttgtctgtaagcggaggtaatgaaaaatcgaattttattggtacgttaggatacaccaatcagacaggtataagcataaattcaggaatggaacgttttaccggtcgtattgatgcaaacagtaaatggaataaatttgagtatggaatgaatgctaccttttcatggactcgtaataaacatacgccggagggacagtattatgccagtgcgctttattcttcaaaatatcaattgaccccttccatacctatttataatgaggatggcagttatcatacgggtttccagaataatggaggtattaacccgctgtatgagaattctgtagattcaaattatgcacgtctggcacgtacaatggcatccgccaaggctgcttatcatatcttggacgggttgaagttatctactatctttacagtagactattctttaaataaagactttttcttttactcgcctgacggtaaggatggggaagctacacagggatccggacagatgatgatgattgagagaatgagttatacttcacaaacgaatctggcatataataaaacgtttggcaaacataatattaatgcggttttagcgtatgaggttatgaaatacgattatgaggatatgtatggtgagaaacaggtttacgggcaaacacttaatccgtcgttggataatggcgccaaacctgctgatcttactaatacgaggcaggaagatgctatggtgtcgtatgtaggaagcttgaattatggatataatgataaatattatgcaggtttcagtttccgtcgtgatggctcttcccgattggcgcctgatacccgttgggggaacttttgggctgtttccgcttcatggagactctctcaggaaaacttcatgaaaccgtgggaggatgtggtgtcggatatgaaattaagagcatcgtatggtgtgaacggtaatctgccgaccggttattatggttatcatggaacttatactaccggagcattttataatggaaaacctgctccgtgggaagatgctattgctaatcctgatttgacttgggaaaagaactatgcattgaatctgggggttgatttaagtctgttcagacgggttaatttgactttcgattggtataccagaacgactaaggatttattgatgagtaagcaattgaattctatcagtggttttggcagtattcttacgaatgtgggcgaaatgaagaataccggttttgaaatagaggtacgttcaagtaatattcaaaccaaagattttagttggacaacttctttaaacttgtcacataataaaaataagattgtaaaactggcggatcttccggaatttatagatggaaattatatcagaaaggaaggttgttcgtatgcgacaatttatttgagagagtatgccggagtggatcctaatgacggacgcccgatgtattatgacaataaagaagacgaaaatggcaatagaagcaggaatattgtgtatgaccccaatgatgccgaccgtgtggagttgaaagatatatatcctaaattgaccggtggattgatgaatacgtttaattataagtttattgatttatcttttaatttgtcgtttcatttaggtggatattcttacgatggtgccatgtatgctttgcaggatgacggttatacggcacaatacaataagagtacagagttacgccgccgttggaaacagccgggagatataacagatgttccccgatatgtgtatggacaagagtatggtggctggtggaactcgtcacgtggtgttcatagcacagatcatttgcgcttgaaaagtttgattgttggcgtttctgctcctcagtcttggttgagaaccataggtattaattctgcccgtatttatttttcgggtaccaacttgttgacgtgggctgcatacgatcaatatgatccggagttgaatggaattgtaagttattttactcctcctcttaaaacattcgcatttggacttgaacttaaattctaatcaattaacaccgaactgtttatgaaaaaaaatataattatattaggcttgatttctttattggccgtatcgtgcggggatgattttttaactactcatcctggtgatagcgtttctacggatttggcactgagtacagagcaggatatagataatgctgtgaatggattgtatgatttgatgtccagctatggctattatggcggaaccatgtttttttatggggatatgaaaggggatgatatgcagagttcttataatagcgggagaacttgtaaccggtgttacttatatgatcatcgctctacaagcttaaatgccggatatttatggggacgtcctttttatattatccgtaatgcatggaatgtgatcaatgcgattgatgatggaaaagtgcaaggttcagagcaaagattaaaggaattgaaaggtgaggcgatgactatcatggcactttgccagtttgacttgacccgttgtttcggttatccttatactaaggataaaggggccggttggggagctccaattgtagatcatgcaattacattagatgaaaatccgccacgcagcactgttgcaaaggattatgagttcataatcagtacattggaggaggctatacctttaatgagtacttctaaaaataacagccggatgaatgcgtatgctgcaagagcattgctgtctcgtatttatctgtatcatgatgataacgagaaagcgtttcaaatggcaagcaacttgattgaagaagtggaaggaaatggaatgtaccgtctttatacacgtgatgaatatgttccggcatgggatttgaaaaatacgtttggtacggaatcattatttgaaattgctaatagtacagatgataatggaggacgaagttcattggcatatctgatgcattggaatgggtatcgtgagatttttgccactcagaaatttgtggatgagttattgagtgacccggatgatattcgctgtctgttgctggaaaagaatgtttataataaaaatgatgtatggtggttgaaaaaatggccgggaacagatgctacgactccatcttttgaaaataattatgttattttccgtttgtctgaagtctatttgaatgcggcggaagccggagtgaaaataggtggggcatctgccgtaaagggcttgaattatctgaatgcaattgtgcagcgtgctaatcctgcaaaggaagtaacggcggctgaatatacattggatagggtgttggaagaaagaagtaaagaattgataggtgaggggcatcgtttctttgatatgttgagaaatggaaagaccattgttcgtaagggaggatatcatttaccgggtatcgtggaagaaatagactgggattattataaatgtgttttaccgattccaacagaccagtttacatttagtcctgatatggagcagaatccgggatatactaaaaattaattttaaataattattaaatgagagggtgtggtatcacaccctttttttgtgtggacaaattctacattcatgtggatttattctacaattttacagacgttccgtttgtttatttggctaatatacagtgatttgacggatgcttcttgttgttggcatatcttttgatcggaacatgataaattattatataattatataaatataaatcatgaataaatctaggtatgttttttttattttggcttgtttattcggtttgtacgtgcaagctcaaaatagaacagtgaaaggacgcgttctctcagcggaggataaagaaccattaattggagctactgtcaaaatacccggtacatctatcggtgtggtgacggatatagatggcaatttctctctggaagttcccgacaaagacaaaacattagtgattgagtttttaggtatgagtacactaacggcgaagatacctgccaatggggtgctgaatgtatctttgcatccggatacacaacgattggatgaggttgtggtgacaggctatggtaatttttccaaatcttcatttaccggttcggcaaatacattacggggggacttgttgaagaacgttccggttgtatcggtagaacagaagttgcagggtatgactccgggcgtatccatttcgggaaattccggtcagccgggtgctaatcaaagtatacgtatccgcggtatggggtcattcaatgcatcgaaagaacctttgtttgtcattgacggagtaccggtgacttccggaagcttgagtggtggctcggcagatgccgcttacatgaataattctaaaacgaatataatgagtacgctgaacccttcggatattgaaaatataacagtcataaaagatgcggcagcggcttctttatatggttcacgtgcggcaaacggtgtgattctgataaccactaaaaaaggtacaaaaggacgtgctaaggctacattaaaaatggatggaggcttttctaatgctgctgtggaattccgtccgacgttgaatggggagcagcgtagagagctaatttatgaaggtttgatgaactttcaacaagatgaaatagccaagaatccggaggcgggattggcgtcgcccaccgagtatgccgatttacatatcaatgattatgcctccattccggaactgggatatactgactggaggaaggaattaatgcgtacggcacatcatcaaagttatgaagcgtccgtatcgggaggcaatgacaagactacgttctattcttcattgggttttaaccgtcaggagggtttggtggaaaattctaatctggacagatatacagctcgtttgaatgtaacccagaaggtaggttcccgtggggaagtgggcgccaatgtgatgttctctcaattgaatcaggaaatgaatgaggagcgtggatcatctattaatcctttcctttgtgtggctttgaacaccactccgtcttttccggtacgtgacgctgaagggaattatgtaggatcatatcccagtagcaatgtgaatccgttgcgtgatatccgtacagattataaccgtacccgcatgacacgtatgttttctacaggctatgcttcgatagatattatcaaagggttgaaattgaaagaaacgcttagctatgattataatattcagaaagattcccgttattggaatccgttgagtggagccggagctaaaagtggtagtgatgcacagacggcaaagggatttatagaatatagtaaattgatttcttccacttcattgggatataatacgactatagcacaattacaccatgtggatgcgttggtagcttatgaaattgaaaattatcagactgacaaagcaatgggggataaatccaaacttccttcagattatttggtggaaccggataatgcagcatcattgaacagctttgtgtcttctactcaggattcaagaatgatttcttatgtatcccgtatcaactatgattatgatgaccgttactatattgccggtagcttccgtcgtgacggcagttcgcgcctgtcacccgagaaccgttggggaaatttttggtctgtatccggtatgtggaatgtaggtgcggaaaaatttatgcaatctataaagagtgtgctgagtgatttaaagatacgtgcctcgtatggtgtgaatggtaatcagccgggtgctctttacggatatatgggactttattcctacgggcagaattatatgggaggtggtggatcttatgaatcggcattaccgaatccgaatcttaagtgggaaaagaactataacttgaatttgggacttgacctggcgtttatcaatcgtatttttgtcagcttggaatattataatcgcgatacgaaagatttgctttacaatcgtcctatcagtagcactaccggtttccaaaattatttggggaacttgggacaactgaataatagaggttgggaactggaactgcgtaccataaattttgccggtaacaattttaattggacttctgttttgaatatgacccacaataaaaataagattgtatcattggatggtaaattggaacagtctatcgagggaagctggtttatccataaagtggggttgccgtattctactttctatgtgaaagaatatgcgggggttgatcctcagacaggaaaagctttgtactatatgaatacacaggatgcaaatggcaattatgacaaaacagttactactgacgcttctgcagcacaggcaattccttataagtctgtggatccgaaaatttcaggaggttttaccaatatcgtgaattacaaatggtttgatctggcattgacgttgacttattctttaggaggatattcttttgacaaaaccggaacctataatgaaaccgacggtgcaaaagaacagaactataacttgcccatttatgaattggatcgttggcaaaagccgggtgatgtgacggatgtaccccgatttgtacttggccaggcggcaggacctcagaattcatcccgttatgtacatagtacggatcatttacgggtaaagaacttgactttgggctttacattgccggatcagtggttgaccaaactgggtgtcagtaaagcaagattgtatttctcaggcagtaacctgttgacgtgggcaaagtggaaccagtatgatccggaagtacctgtttccggcgaagtattttgtgaaacacctcctatgcgtacttacagttttggaatagaagtctcattttaatgaatttcctttaaattagaacaaaatgaaaaaaatatatttatcgattgttgcggctgtatcattgatgtttgtttcgtgtactgctgattggctgaatacagatccttctacggcagttcccagtgatgatgccattaaaaatatagatgatgcacaggtggcattgaatggtatataccgattagcatccgcacatagttattatggtgataattatctttattatgctgattgtcgtggagaagatgtgcaggcacgtattaataaaggagcaggccgcagggtttcgccttactatttctttgatgttacggcggatgataattttaatataacccttgtctggaaccaaccctataaagtgatccatcaggctaacagtctgatagaaaagttggatgccggaaatgcggggaatgccaggccggaagaagtggcacggattaaatcggaggcactggcaatgagaggactggctttatttgatctgacccgtttgttcggtatgccttatactttggataatggggcttctttaggagttcctattgagattcagactaccttggaagatcatgctccggaacgtaacacagtggcacaatgttacgaacaagtgctaaaggacttgaacgatgcgttgggaggactgacaaaggaaaaacatgatgcctatatgaattattggagtgtgaaagctttgctttcccgggtgtatctgtatatgaatgacaatgaaaatgcattgaaatgtgcagaagaagtaatcaatgacaatgggggaatttaccggctttttactcatgacgaatatccttctgtatggggaaaagactttaactctgagtctttgtttgaattctattttacgatgtctgaaccttcaggcggttcgggaggagaaggggcgccgatggtgtatgccgataatgtgaaagattggaataacctgattctgacaaaggcttatttggatttgctgaatgaagaccctgaagatgtgcgccatgtatttcctcatttgccggaaaatgccgttgcggatacattgcctgtagctgccaaaggtcaaccgaaatatctgattaaatatccggggaaatcgggcagtgtgaccgatgctgtttctacagtcaatccacaggataatgatctttgtattctccgtttatccgaggtctatttgaatgctgcggaagctgcttttaaaatcggcaatacggaaaaagcattgacatatctgaatgcgatagttacccgtgccaatccggcgaaatccgtaacatctgctgatctcagcctggagcgcattctgaaagaaagacgtaaagaactggtaggtgaaggtcatgctttctttgattatatgcgtaatggcaagtcggtggaccgttcgggaggctggcatctgactatgcctgaagatgcccgtgtcattgctccttcagaccctagggtggcacttcctattccacaaacagaaattgatgctaatccgaatatagttcaaaatcctagataattgttttgtccatgttaagtttgcccttcttttcgatgatgatatcggagagaagggttttctttttacaatttatatggtacaaaatcatatttcgtccgtcttcatttgaaaagaaagaccaaaaatatgagattatatggattgttactgtgcggatggatgacggtatccttacaggcccaacaaatacatgattgggagaatcatcatgtattacagattaatagggaaccggcaagggctgcttttgtgccttttgccaagcagaagggggattgttcgatgagtctggacgggatgtggaaattccggtggactcctgtgccttccgaacggataacggatttttaccgcacggactttaatgacaaggattggaaagattttccggttcctgccaattgggaaatcaacggatacggaacgcctatttatgtatcggcaggatatccgtttaaaatagatcctccacgggtgatgggggagcctaaagcttcgtataccacctacaaggagcgtaatccggtggggcaataccggcgtactttcacgctgcccgccgggtggaaggcaaatgggcagacttttcttcgctttgaaggagtgatgagtgctttttatgtgtggataaacggtgaacgtataggttatagccagggaagtatggaacctagtgagttcaatatcacccgctggttgaaaccgggagagaaccaaatcgctctggaagtttatcggtatagtgacggatcttatctggaagatcaggatttttggcgttttggaggtgttcatcgcagtattcatttggtgcatactccggatatccgtatccgtgactatgtagtgcgcactctgcctgctgttcaggggaattatcaagatttccgactgctgattgatccgcagctcagcgtttaccggggaatggacggtaaaggttatacgttgcaggcggtgctgaaggatgcggatggaagggaagtagtgaatatggttggcaatgtggaagatatcttggatttggagcataaggcggcacggatgaatgaatggtatccgcaacgtggtccacgtaagatgggacgtatatccgccgttataaaatctccgcaacgttggacagccgaaactccttatttatataagttggaacttcgtttacagaatgcaaacggacagaccatagagcaagtggaacagccggtaggttttcgttgtattgaaataaaggacggacaaatgttggttaacggtaattcggtccgttttcgtggggtaaaccgtcatgaacacgatccgtatacggcacgcgtgatgagtgaggagaggatgttgcaggatatattgctgatgaaacaagccaatgtgaatgcagtccgtaccagtcactatcccaatgtgagccgttggtatgaactgtgcgacagcttgggactgtatgtgatggatgaggcggatatagaagagcacggattacgtggaacattggctagtacacccgattggcacgccgcttttctggatcgtgcggtacgtatggcggaacgcgataaaaatcatccttcggtagtgatgtggagcatgggaaatgaaagtggttacggacctaattttgctgctatttcggcttggctacatgattttgatcctacacgtcccgtacactatgaaggagctcagggagtaaacggagaacccgacccgaaaacagtggatgtaatcagccgtttctatacccgtgtgaaacaggagtatctgaatcccggcattcccgaaggggaggacaaggaacgggcggagaacgcacgttgggaacgcttgttggaaatagcggaacgcacgaatgataaccgtcctgtgatgaccagcgaatatgcacattgtatggggaatgctttaggtaatttcaaggaatattgggatgagatttatagtaacccacgtatgctgggcggctttatatgggactgggtggatcaaggtatttataagatattgccggatggccgccggatggtggcgtatggcggtgactttggtgatcggcctaatttaaaggctttctgttttaatggtgtggtgatgagtgaccgcgaaactacgcctaaatattgggaggtgaagaaagtatatgctccggttaaattggaaatggaaaaagatcttcaggtttttccaaaagaacaagatgttttgcccaaaggattaagagttacgaaccgtaatcatcacattggtctggaaggatatcgctgtctgtggactttgatagagaacgggaagaagatgaaacaaggggaactggcgcttccatcggtggcacccggtgaaacaggaacgatggctttgcccgatgttaagattaataaacaggctgatgttcgattgaatgtaagtatagtattgaaagaagatgctttatgggcgaaggccgggcatgagattttaaaggaacagtttgccttgaatgatcatttgatggcggtggctgacggtgtacaaccgggtaaacgtaaaagtaagttttctgttttggatttatgggaagatagttattttcaagctttccgtgctccgacggataatgataaaagtttcggtaactggttggccaaggattggaagaatcagggattggatgctcctcaagtagaggtaattactcccgaaacgaaaactcaggaaacagatggaaccgtatcgaagaaatcggttgtggaatatcgttatgccaaaggtagcatccgtgtttcttcccattataaaatatatgtggatggaacggtggatctggaacagacttatctgccacaaggagaattgccggaattgcctcgtctgggcagtgcatttgtattgggagaagaatatgagaacctttcctggtacggtcgtggcccgtgggaaaactatcccgaccgtaagacgtcctgtctgataggtagatggaacagcaaggtgagtgaacagtacacacattacccgcgtccgcaggacagtggcaatcacgaggatgttaccgaggtgattctaaccaataaacagggtaaaggcgtccgtgtgaccgccatagaccggccattttcattttcggccttacattataccgtggatgatatttataaaacaactcatgattgtgacttgaaaccacgaaaggaggttgttctcagcctggatgctgcggttttaggtttaggaaacagtagttgtggtccgggagtgctgaagaaatacgccattgataagcagaaatctcatactttgcgggtacgcttcagtcttataaaatgatgtatggcaaaaggtttgaataggcgacggcgacatatctttccggtggcagacagaaatatagaattaaattaaaaatcaaatatcaaaatgaaaagagcaacaacttttttatcactccttgctttatcggcaggtttgttggcgcaatcttccgtaaaaacagaacgccaatacttgtcaggacgtggctgtgatgatatggtacaatgggatttcatgtgtaccggtggtaataattccggaaaatggacgaaaatcggagtaccttcctgttgggaactgcaaggattcggtacttatcaatatggcatgaaattctatggtaaggcttttcctgaaggagtagctgacgaacaaggtttgtataaatatgaatttgagttgcctgccgaatggaatggtaaacagatagagctggtatttgaaggctctatgactgatacgcaggtaaagataaacggtcgtaaagccggctccatgcatcagggagctttttaccgctttatttataatgtgagtgaccgggtatttttcggatcgaaaaaaaagaatgtacttgaagtaactgtaagcaaggaaagtgcgaatgctggggttaatttggcagaacgtcgtgctgattattggaatttcggaggtattttccgtcctgtgtttatcgtggcgaaaccggctcaaaatatagatcgtctggtaatagatgcgaaggcggatgggaatttctatgccgattgttttctgaatatggcagtagaaggtgctagggtacatactgtcataacagatgctaaagagaaaaaagtggccgaaaatacttcggatgtccgtacgggcagcgaccatgcttcgattaatttcgcagtaaaatctcctgaattatggacggctgaaactccggccatgtatcaggctacctttaccctgcttgataaagcaggcaaaacattgcatgttgaaaatcagaaatttggtttccgtaccattgaaacacgtgaaagtgacggattgtatatcaacggtcggcgtgtgatgattaaaggggtgaaccgtcatagtttccgtcctgaaagcggacgtacactgagcaaggcaaagaacattgaagatgtattgctgatcaagagcatgaacatgaatgccgtccgcctgagtcattatcctgccgatcccgaattttttgaagcttgtgactcgctggggctttatgtaatggatgagttaagcggctggcatggcaagcacgaaaccatcaacgggcagaagctggtaaaagaaatgattacccgtgatgtaaaccatccgtgtattatctggtggagcaatggtaatgaaaaaggctggaatactgaactggatggtgaattccataaatatgatcctcagaaacgtccggtgcttcatccgcaaggcaacttcagtggatatgaaaccatgcactatcgttcttacggagaaagccagaactatatgcgtctgccggaaatatttatgccgaccgagtttctgcatggattgtacgatggaggacacggagccggactgtatgattattgggaaatgatgcgtaagcatccccgttgtgccggaggtttcctttgggtactggccgatgagggcgtgaagcgtgtggatatgaatggattcattgacaactgcggcaattatggagccgatggcattgtaggtccgcatcacgaaaaagagggcagttactttaccatcaagcaggtgtggtgtcctattcaaatcatgaccgatagccttgacagtcagtttgacggcaaactgaaaatagagaaccgttacgatttcctgaatgcgaatacatgccgtttcacttataaatatgtgcaattgccttctgtaaccgataaggggggaatgaaagtgatgaaacagggagaggtgaactgtcccgacattcctgctcacggtgcgggtacactgactattcctgcggctgtcaagggggctaatgctttgatgctgacagtaacggataagcaggggaatgatctctttacgtggagttataaactggacgacgttgccggattgcaacaggtttctgccggaaacaagccttcttataaagaaactgccgatgcattgacggttgatgccggaggacgtacatttactttttctcagaaagacggacagctgaaaggggtaaaggttggaagccgtatcatcagtctggcaaatggtccccgtttcattgccgccaagcgttcggaccgttctatggatcagttttataaccatgatgacaaagaggctgaaaagaagaaaacccaatacactacatttgatgatgccggtcgttttacaggctttaccgtgcgtgaagaaggcaataacgtagtggttaccgctaactacaaactgggatgttttgatcaggctgtatggactatcgctcctgacggtaccgctgctatagactttacatacaacttcagcggtgtagtggatttgatgggggtgatgtttgattatccggaagataaagtgttgagcaagcgttgggtaggtgacggtccttaccgtgtatggcagaaccgtctgcatggtccgcagttgggcgtatgggaaaatgagtataatgatcccattcctgccgaaagctttacttatcccgaatttaaagggtactttgctaatgtgcaatggatgactttgaaaacacaggaaggaacgataagtatctgtaaccgtactcctcagaattatgtaggggtttatcagcctcgcgacggtcgtgacggcttgctttatactttcccggctaccggcatcagtctgatgaaagtaattcctccggttcgtaataaagtgaatacgacagatttgataggtccgtcttcacaagcattttgggctgatggagcatatgggggaggtatcacgttaaaatttgaataacagtgaaaaaatagattgtaaagggaagaggaactttgtttattcttcccttttctttttttatttggcttgaactctctatatttgaaaaattgagtacaaattacaactttattcgtttatcattaaatatagaataaatagcttatgaagataaaacatctgtttgtatccatattgctggcaaccggattccaaccgatgatagcacaatccgctttacggcaacagtttgtaaattcatccgtacaggaagctcgtccctggactttctggtattggatgtttggcgctgtaactcccgaagggattaccgctgatctggaagccatgcaccgtgtaggtttgggtggagcctatctgatgcccatcaagggagtggagcaaggacctcaatacgaaggaaaagctcaacaacttacccccgaatggtggcgtatggtcactcatagtatgaaagaggccgacaggctgggaatgcaactgggaatgcatatctgtgacggctttgccttggcgggaggtccctggataactcccgaagagtcgatgcaaaaagtggtatggagtgatactatagtgaacggtgggaatattcgtaatttgactttgcccatgcccgaagcactggatggctattatgaagatatcgttacctacgccattccattggagcgtcagcctgaggatacttcattgaagccgaaggtaactttcggtaatttgaaatcggctgttatcaaagatgaatccaaagctgtgaacagagatgagaaaggagttttccgttcctcttatccttgttggattcagtatgaatatgcagaacctgtgacttgcagcaatgtggaaattattttgggaggaaataactaccaggcacatcgtctgaaagtattggccagtgaggatggacggacattcaaaacagtgaagcaactggttcctgcccggcagggatggcagaatacggatttccagtccactcatgctatccctcctgttaccgcccgttacttccgttttgagtggactcccgtgggaagcgaaccgggtagtgaggatctggatgcagccaaatggaaaccgaatttgaaaatcaatgatatagttcttcatacggctccgcgtattcatcagtgggagggaaaagcaggactggtgtggcgtgtggctactgctactacttcgacggaaatacccgatgcggcttgtgtgcagccggatgagttgatcaatctccctttgtatcagggcaggctgaccgcccgtttacccgaaggtaaatggcgtattctccgcatgggacatacggcaaccggacatgtgaatgctactgccggaggtggtaaaggattggaatgcgacaagttcagcaccaaggctgttcagaaacagttctcgaactggtttgcggaaatgttcaaaaagacggatgaagccgtggcacgccgtgtattgaaatatatgcacgtagacagttgggagtgtggcagtcagaactggagtgataacttcgcggcggaatttaagaaacgccgtggatatgatttgatgccttatcttcctttgctggcaggtattccgatggaaagcgccgcccgcagtgaacagatattgcgggatgtccgtaccaccatcggagaactggtgacagatgtgttctacactgtattggcagactgtgcccgtcaatacgattgccggttctctgccgagtgcgtagctcctactatggtcagtgacggattgatgcattatcagaaagtggatctgcctatgggggaattttggctgaacagtcctacgcacgataaacccaatgatatgctggatgccatcagtggcgcgcatatttatggaaagaatattatccaggccgaaggctttactgaaattcgtggcgtatgggatgaagaccctgccatgctgaaacctttgctggaccgtaactatgcactgggtatcaataaactcttctttcatgtctatacccataatccttggatgaaccgccgtcccggtatgaccttggacggcatcggacttttcttccagcgcgaccagacctggtgggaggaagggaaatcttttgtagattacatcatccgttgccagactttgttgcaatacggtcatccggtggttgatatcgccgtctttaccggtgaagaaatgccgcgacgttccattttgcccgaacggttagtttcgatgcttcccggtatctatggagccgaacgggtggaaagcgaacggattcggctggctaatgaaggtcaacccacccgtgtgcgtcctgtcggtgttacccattcggcaaacatggccgatcccgaagactgggtgaacccgatgcgtggctatgcctacgattcttttaacaaagacgctctgttacgtttggcaaaagcggagaatggaagaatggtacttccgggaggagcttcttataaagtattggtgcttcctacagcccgtcctatgaatcctgataacctgccgttgtctcctgaggcacaggcaaaagtagaggaactccgcgcggcaggtgtcattattccgcaattgccttatcgggaagatgatttttcttctttcggtgtggaacgggatgtacttcttcctgctgatgtggcatatactcatcggagcggggaagagtatgagatttattttgtggctaatcaggtggacagtttgcgtacattcaacgcttctttccgcattgcagggcgcactcctgaattgtggaatgcggtaacaggaaccattacccgtccggcacaatggaaagaagcggacggccgtaccgaagtcgctttgtctttgccagccaatggctctgtatttgtcgtattccccaaagaatcttcagaagtttctccggaacggatcgaaagggaacctgtatccatatcgatcaaggaatggacagtaacattcccttccgtgcgcaaaactgtcactcgtccggtattatttgactggagtaaggaagaggatgaaaaaataaaatattattccggacatgccacttacagagggctattcagatggaagaatgaacaggacggaagaattattcttcggttgggtaaagtagccaatgtagcgactgtacgtgtcaacagcattgcatgcggtacggcttggacagctccatacgaagtggacattaccgatgcgcttcgtaacggaaccaatgtcttggaagtggaggtggtgaatacctgggcgaatgcgctccgtggggcagatcaggataaagcgccttttgaggggatatggacgaatgcaaaattccgtctgcccggagatggtttgttacctgccggatggatgggaccttgcgagttttttaaaactaaagaataatgctaatcacacataacatgaaaaataagaaactactactgggcattgcttgggcatggttgacttgcctgtcggcaaatgcggaagtgaaattgcccgctttcttttcagacggcatggtgatgcaacagcagactcgtgccaatttatggggaacagctactcccaatgcaccggtgaaaattacaacaagttgggataaacaaacctataaaacgatcgccgatgcaaaaggcgcgtggaaacttgctttatccaccccctctgccggaggcccttacacgatcacttttgatgatggaaagctgaccgaaatacgtgatatcctgatgggagaattatggttatgctccggtcagagtaatatggaaatgcccatgaaaggttttaaaaaccagccggtggagaatagcaatacagatgtgatgaacagccgtaatccgcaactccgcctgttcaccgtaaagcgttcttcctcttttactccgaaaacagatgtggtgggaacctggcaggaagctgttccggcaactgtgcgtgagtttagtgctactgcttattacttcggtcggatgatacaacagcagttgaatatacctgtgggtttgattgtggcttcttggggaggttctgcctgtgaagcctggatgcatccggattggttgaaggcatttcccgaagcaaagattccccaatcggaagccgatatcaagtcaaagaaccgtactccgactgtactctataacggtatgcttcatccgctcatcggattagccatgcgtggagttatctggtatcagggggaagataactataaccgggcttctacttatgccgatatgttcagtgcactgatacgcgggtggcgcgaagaatggcagcaaggggaatttcccttctattattgtcaaattgcaccttatgattatggaattattactgagcctggcaagaatgtgataaattctgcttatcttcgcgaacaacaagctatggtagaacaccgggtgggcaatagtggtatggctgtattgttggacgcaggaatgaaaacggggattcatccgggtaaaaagaaggtggcaggagaacgtctggcgcgtttggcattggtaaaaacttacggaatgaaaggtgttacggccgaaagtccttactatacaggaatggaagtaaagaatgatacggtaatagtcagttttgatcgggcaccgatgtggataaattgtaaagaccgttttgaatcatataactttcaggttgcaggtaaagatcgggttttttatcctgctaaagcgtggatacagagaagtaaaatgcttgtaaagagcgagagagtacctcatccggtggcagttcgttatggcttcgagaattatgtggagggagatttgtttggtgaagatttacctgtatcgtctttccgttccgatgactggtaaaaacagaaaaaaatgaagaatatctttacgtttttattattagtgtttattggcgggcagtttctgtggggacagcctgccaatttggtttggaatattcaaagccggaatgcttcggagtctatgccctgcgggggtggtgatatcggcatgaatgtatgggtagagaatgacgatgttctgttctaccttagtcgtagtggttcttttgacgagaataactgtctgctgaagcagggtcggtttcgtgtgaggctcactccgaacccttttgccggaacggcttcttttcggcagactctgcatcttaatgatggctatgtcagcgtaagtagtgataatgccactctaattatttgggtggatgtgtttcatcctgtggtacatgttgaggtgaaaacgaaggaactgacttccatgcgtgtgaattttgaaagctggcgttatgaagatcgtccggtgcgtaaaggggaagggcagcaatgctcttacaaatgggccattcctgatggattgatgactaggcgtgactctgtctgtgtggaagaagataattttacttttttccatcgcaatcctgaacgtactatttttgatgtggtagtggaccagcagggaatgaatgaagtgaaggaacaactgtataatcctttgaagaatttgatttttggggggcgtttatcaggtgataatctggtttataacggtacacgccgtggacattatgcaggtactgagtatctggcatggatgtacaaaagcaagaaacctacttataagcagtctgcacggattgttctgaatacggaacaaagtacggttcctgcatgggaagcatccttggcccgcactgagaaggaaataaatgtatccaaagacaaacaggctacccgccgttggtggaatgatttttggaaacgtagctttattgagggggaaggtgaagcgggagatgctatccgtaactatacactgttccgctatatgttgggatgtaacgcctatagtcagtggcctaccaagtttaacgggggactgtttacttttgatcctatgtatgtagatcagaaaatggaatttacccctgatttccggaaatggggaggaggaaccatgactgcacagaatcagcgtctggtttattggcccatgctgaaaagcggtgactttgacttgatgaaatcacaatttgacttttatctgcgtttgttgccgacagccgaagcacgtacccgtacctattggggacatgccggtgcctgtttcaccgaacaaatggagaacttcggtctgcccaatcctgccgagtatggctttaaacgtcctgaaagctatgacagggggttggaatataatgcatggctggaatacgaatgggatacggttcttgaattttgtcagatgatactggaaacggcacgttataatgaggctgatatcagccgttatatccctttgatagaaagctcacttaatttctttgatgagcattatcgtcaactggcattacagcgtggacgtaaggatttagatggtaacggcaaactggtgatttatccgggatcggcttgtgaaacttataagatggcttataatccatcctcaaccattgccgcgctgcgctctgttttacaaacctacggacgtaaaccggacatgctggcacgtattcctgagatccctttgcgcatagtggatgggaaggaaatgattgctccggcacaggcttgggaacgggtgaacaatatagaaactccccagctttatgctgtatttccctggcgtatgtatggagtggggaaggaaggtctggaaatagcccgtaatacctatctatatgatcccgatgcacagaaattccgttcacatatcggatggaaacaagataatatctgggcggcttgtctgggtatgaccgaggaggctgcacaacttaccttagagaaaatggcgaacggtcctcatcgttttcccgccttttggggaccgggttacgactggactcccgaccataactggggaggcagcggcatgataggtatgcaggaaatgctgttgcaggaagccgatggaaagattttattgtttcctgcttggcctaaagattgggatgtgcatttcaaattgcatgctacaggacagactactgtagaggctgttctaaaaggggggacggtggttagcttgaccgtattacctaaagaacgggagaaagatgtagtaaattgtttgctgaataaataatttaagggtaaggaggtgtgttttgtaaattcacctcctacttctttgtatatactcgattgggaacttgtcactccttttgtttttctattcttatctatttgtatggcaatcagtgccggaacattgtttgatggctttggttatctttgttgcgtaaacaagaactaaaatgtccgatgctttgttcttactatcataaatagatttaaaatggttatgaaaaagattttgatagctttggccttattgctgacaggcattgcaagcggatcggcatgtaccggtatttcattcctcgctgaagatggcggatatgtgcaggcacgtactatagagtggggggacagttatcttccgagtgaatatgttattgttcccagaggacaggatttggtatcttatactccaacgggtgtaaatggcttgagatttcgggctaaatatggtctggtaggactggctatcattcagaaagagtttgtggctgaaggactgaatgaagtagggctttcggctggattgttttattttccccattatgggaagtatgaagaatatgatgaggctcaaaatgcaattactttgtcggatttgcaggtggtgaactggatgctttcccaatttgctactatagacgaagtgagagaagctatagaaggggtgaaggtggtgtctcttgataaacctggtaaaagttctacggtacattggcgcattggcgatgctaaaggaaatcaaatggtgttggaatttgtaggtggtgttccttatttttatgaaaataaagtaggagtactcaccaattctcccgattttccatggcaggtgactaacttgaataattatgtaaatctatatccgggagctgtcactccacagcaatggggtggggtgactattttcccttttggcgcaggtgccggatttcatggcattccaggtgatgttactcctccatcccgttttgttcgtgtagcgttttataaggcaacagctccggtgtgtcctacagcgtatgacgctatattacaaagctttcatatcctgaataattttgatattcctatcggtatagaacatgcgttagggaaagcacctgatattcctagtgccacacaatggacttcggctattgatttgacaaacaggaaagtgtattataaaacagcatacaataacaatattcgttgtattagtatgaagaagattgattttgataaagtgaagtatcagtcgtatccattggataaggagttgaaacagcctatagaagagattattgtgaaatagtgcaagggcttggaaactgttggcggaagtacatggaagttttaattgcaatgaatgaataatggataaaatgcattttttttagaaaaaagttctagaaatgtttgcagatacaaaaataaactgtacctttgcactcgcaattcggaagaatagcaataataaaggattgattcgctagctcagcaggtagagcacaacacttttaatgttggggtcctgggttcgagccccaggcggatcacttgaaaatcagagagttacactaaagtagctctctttttttatgcccaaattgtgctggtttacatggttcagttaaaccgagagttaaacggggatcagtttgaaaaaacttgggggaatcttttcttttttgtagagaacacagttgaacttttaaaaaagaattatatttgtactattcattactgaaactatggcgaagaataatttactaagtgagcaacttgcttatattggtgtcagttgtacccctacgcatctgcatttgtgcagttataatgctgaaagtatttgtatgaaggatgggaaagatatagatagtttaatcccttatttgaataagaatgctataaactggatacaaattcatggctttcagaatacggaggtcatacagcatgtctgtcagaattttaatgtcgactttttgacgatacaagatattttgaactccgaccatcagaccaagatagaacagcatgatacatataatgtagtgattttgaagttgcttttttctaatgatgatggctatgtaccacaacaaatagccattgtgcaaggtggaaattatctgttgacttttatggaaaaggaaacagactttctgaatgatataaatacggcattggaaaagaatgtgttgaaaatacgtagccggcagtctgatttcctgctcagtgttattctaaacagtgtgatggccagctttatatccatcatttcggaattggaagacggattagaggatttagaagagcaattgctttcgccggaacaggctgatatgctcggtattgaaaatatacagcaataccgtcgtaattttcgtgtaataaagaaatgtattttaccattaaaggaggaaatcagcaagttgttgcatccgatcgataatgatttgttgcacaaagcaagccgtcctttctttaatgatgtcaatgatcatttgcagtttgtattgcaaactttagatggttgccgtgacatgatttcagctttggtagatatttacctttccaataatgaccgacggatgaacagcatcatgaaacagctgactgttgtttctactatatttattccgttgacttttctggcaggaatctggggaatgaatttccaatggatgcctgaactgggatggcggtatggctatgtatttgcatggacattgatgttgatactagtagcagttatctacttctattttaagcgtaaaaaatggtattgatgagagaggatggatgggatttacttaaatgtgaatcccatattcatgttttacttcattcattacaaaggtgctttccagtgaacccaaactgtcaatcgtgcccaagacattgaggataaattcctgataatacttcatattaggggagtgtattttaagcaaatagtcataactgcctgatatgttatagcactctgttacttcagggatatcctgaattatccgtgtaaattccgcagcaatgtcccggttcagtcttcttagcttgacactgcaaaataccacgaagccttggtttagtttctcagcgtccaatacagcgatatatttttttatatatcctccattttccaatcgtttgaggcgttcgaacaccggagtggaggaaaggcttacccgtgcagccagttctttggtggtcagtcgggcattttcttgcaaggtacgtagtatctgcaaatctactttgtcaagtttctctaaagtactcatagaataatattttttcaagaggttcatatctgttaatacaaatatattgcatttattttagattccggagaattttcgggaaatgtagtacagggttatattctttttttgccggagaatgcaagaaaagggcagaatgattttatctctcaaaaatactttttatctttgcagttgctatgacaaagtatatatatcttttttatatcttgttaggtgtatgcctgttggcgggctttggttccgcatttgatagcggacaggagcacgatgtagttcgtacagttggtttggaaaacagtgcggtggcgctgtgcaacatatctgaaagcaataacgggcaggaaaaaaaagagataaataatgaaagctaccatttttataaagtcggtatcggcggtacagctacctctttttcttttcgcaccttgtgctcttctaaaattctgcgaactcattcctctgcttccgtcatagccaagttggccagattcttgaaagtacttcttcctgaagaaaagcaaatttctttttcacctattctttattttactcaatattcctgtgaatactatatttatcagttgaggcgtattcttatttagtttattttttcttctcggcaaggtctgttttttatatcttacatttttttgtttttatattttcataatgggaactggggtggatgcttgttccttttatgaacggtgttatatgttaataactaatatataatggaatttttattggactttatacttcacattgaccaatatatgatagatattgttcaagaatatcatacttgggcttatgtcatactgtttataatcattttttgcgaaacgggattggttgtcactccattcctccccggagattctttgctttttgtcgcgggagctatttcggctttgcccgatatgcctttggaagttaatattctcgctttggttttatttctttcagctgtgctgggcgattcctgtaattatatgataggacacttttttggaaataaacttttcaataatcccgattcccgtatatttaagcaaagtcatttggaaaaaacacatgaattttataaaaaatacggaggaaagaccatcattattgcccgttttgtacctatagtccgtacatttgctccttttgtagcaggtatgggcaaaatgcattattattattttatggtgtataatctgatagggggagctttgtgggttggtattttctgttatgccggttattttttcggtgatcttccatttgtacagaaaaatctgaaattgctgattgtggctattattgtcgtttctatattgcctgccgttatagaagtaggcaggaataagtggaaaactcgccattactaaaatcaaacatatcaaaaacaatttattcaaattacatttatgaaaaattctttttttagtcgatttacacctcaagaacctaagtttttccctatgttgaaacgtttgtctgaaatcctgacctcatcatcggatttattggtagaaagcatgcagcatgataagccggaagagagagaagactattacaaacgcatcaaagatatggaacgtgaaggtgacaagcagactcatttaatttttgacgaattgggaaaaactttcataaccccttttgatcgtgaggatattcacgatttggcatcaactatggatgatgtaatagatgggattaacagttgcgccaaacgtatcacgatctataatccccatcccattgctaatagtggaaaagagttgagtttgttgatacagcaagcggctgtttatataagtaaggcaatggacgaattggaaattttccgtaaaaagcctactgaattaagagcatgttgtacaaaattgcatgacatagagaatcaggcggatgatgtatatgaactctttgttaagaaactatttgaggaagaaaaggattgcatagaactgattaagatcaaggagataatgcatgaattggagaaaacgaccgatgcggcagaacgggtaggaaaaatcttgagaaacctgattgtgaaatacgcataaaagcagaaggtacaatatggaattattagtgattattattactttggctttgatttttgactatattaacggatttcatgatgcagccaattcaatagccaccattgtgtcaaccaaggttcttactccgttccaagcggtgatatgggcggcattttttaattttgttgcattctttattgctaaatgtataatcggagggttcggaatagccaatactgtatccaagacagtagtggaacagtatatttccttgccgattattctttcgggggttattgcagctattgtctggaatctgtttacatggtggaaggggattccttcttcttcttcgcatacgctgatcggaggttttgccggtgctgctattatggctcatggttttgatgccattcagctcaatattattttgaagattgctgtttttatctttttggcaccatttatagggatggttgttgcttttggatttacgttgcttgtccttcacatttgtcgtcgtgcacatccgaatacggctgagatgtggtttaagaaattgcagcttgtttcttcggctttgttcagtatagggcatggactgaatgattcccagaaggtaatgggtattattgctgctgccctgatcgctgctcattcggaagggttaggaatgggaataaatagtatcaatgatttgccggattgggtggcattttcttgttttactgccatttctttaggaacaatgtcaggcggatggaagattgtgaaaaccatgggaactaagattaccaaagtaactcctttggagggagttgttgcggaaactgctggcgcatttacattgtatctgacagaatatttgaaaatacctgtaagtacaacccacaccattacaggagctattatcggagtgggtgctactaagcgtctttcagccgtccgatggggaataacaagaagcctgatgacggcttgggtgttgactattcctgtcagtggaatattggccgctgttatttacggagtggttactcttttttagaatgaccggattgtaggctgttctagaaaataaagatctgtcgtgaccgaggtgactgggaagttacctcggttttgtatacatacccatttgtaggtaaaaagtggatgaaactaataataaatataaaatgttattgtgagtttgttatttgtttctatttttgtagtggtcttactgaacacaaaaatgagagaaaacgcaaaaggcaggatttttatagcatggctgttgttaatgacgcttatgccatttttcatggtgaagacttttcaccaccatgaagaagatgccgtttgccattctgatagtgggaattctcatgattcctctcatcagtgtcccgtgtgcaatttcacactttcaccttttacacaagttgaaacattacaacttcatattgttcttccggtttttgattatcagccgaaaataacagtggataaggtttgccaggttaaatcttatccttattatctgcgtgcacctcccgtttgctgattcacatagtatcttttatttattcacaacatcaaatgattgtaatttatgcgtatcagatatgtttcgggtacgctgggaatgttttttaccttgttttcaaatgcacaggtagtttctgatacgattaaaagtgtggatttatccgaagtggtggtgactggatcttaccgacatgctcaggagaaaaagactaccctgacactcgagttgtttcagaaagattatttgaaccggcattttaccggtaatttggtacagactttgaaaaatgttcccggtgtacactcgatggatattggtgcgggattctccaaacctatgattcgtggtttgggattcaaccgtattgccgtatccgaaaatggaataaaacaagaggggcaacaatggggggccgaccatggactggaaattgatgcttttaatgtagacgaggtacggattctgaaaggtccgtcttcactgctctacggcagtgatgcgatgggaggtgtcatcgaaatccttcctttgcttccacaaaaagagaaccgattttttggtgaggctgccttattgggaaaatcagtgaacggcactgtgggcggttcactgatgctaggtattgagaagaatgcatggctggtcagagtacgtttttcagaacagcactatggagattatcatgtaccggtcgataccattgtatatcttacccagttggtgcctgtttacggtcgtaagctgaaaaacaccgctgggttcgagcgcaatgtttctgtcatgggagattatagaaagaggttttatcagatgaatattgctgtgagcaatgtttatcagaagatgggcttctttcccggtgctcatggcattcctgatatttcccgtttggaggatgatgagaacagccgtaatattgaattgccttatagcaaagtgaaccatcttaaagtaaccacgcatcaacagtatctttggaatgggatacaactttcaggtgatttcggctatcagttcaatcatcgggaggaatggagtgctttccatacccattatgacactcaggtgatgcctgcaaaggatccggatagggaactggtgttcaaactgcatacattcagctcctctttgaagctgcggttgtccagttcttcttcctgggagcatatggcagggtggaatatgcagatacagaaaaatgcgattggcggatattcttttctgctaccggaatacaagcgttttactaccggagctttttggctgacgactttccgattggataatcagttgtctgtaactggtgggatacgttatgatcggggaaggattgatataacggcattcgaagatccttatttggtggagtatctgcacagacagggatatgaagaagaggtaatacaggcatatcgttggcgaagttatccggtggacagggcttatggtaattattcctgttcggcgggagtagtgtggacacccgctgccggtcatcttctgaagatgaatgtgggacgtagcttccgtttgccgggagtcaatgaattagcatccaacggagtgcatcacggaactttccgtcatgaaaaaggggatgccactctttcttcggaacaaggatggcagattgatgcttcctataccttggcttataaaaaaatggaactggttgtttcatcttttgccagttggtttgataattatatttatttgcgccctatgggagaatggtctgtattgccccatgctggacagatttatcaatatagtggcgcacgtgctttgttcatgggtggtgagataaatttcaatatggattttctacgccattttaattatcgtttagtcggtgagtatgtctatacttataatcgtgacgaacatacggctttaagtttttcacctcctgtatccatgcgtaatattctgacatggaataaaaaggattttcagttgtatgctgaacttcaaagtatagcttcgcagaaccgtatagcgaggaatgaagaccgcacacccggagcttgtttgattcatctgggtgggagtattcatatacctatggccaaggcggatattgaaatatctttgggcattcgtaatttgtcggatgtgaaatattacaatcatttgagtttttataggaaagtggaaatccctgaaccgggaagaagctttcagatttcgattaaagtaccatttaaacaattattaaaatgaaaacaaaattttattttcttgtaatcagccttttggctatatgctctgtttgtctgcctgcgtgtgataatgatgaaaaaggggatgtaacaaagcccgtgatcgatttgatagaacccgaagagggagcggtgttgaaaattggtaatgggaaaggggtacattttgaaatgaatctgtcagatgatgtgatgttgagatcgtataaaatcaatattcataataattttgaccaccacggacatgattcccgggcagccggagagaaaaacacagcttttacttttgacaaggtatatgatgtttccggtttgaagaatacaaaagtacatcatcatgatattgttattccggccgatgctgctcccggagattatcatctgatggtatggtgtaccgatgcggcgggcaatcagacagaagtggctcgtaatattgtcttgagtgcggacggaggtactgaaacggaacatgatcatgatcatgagtgattttttgtattaatcgtattgtgtgtattaattgtctggtggcggtcgatgtgaatcggccgtcactttattttgttagatgtcgccaaagaataattttctttcaggaggtaataatccgtttgtaaatagaatatttgttctataaatagtgataattgtagctctattttctttatttttagtatatcttgtttgatataactgcctttaatacctttgcaacaggtaaaaacagaaatatataactctaaaaagataaagattatggctacaaaaaaattacatttcgaaacattacaacttcacgtaggacaggaacagccagacccggctacggatgctcgtgcagttcccatttatcagactacatcttatgtatttcataactcggcacatgcagccgcacgttttggtttacaagatccgggtaatatttatgggcgtctgactaattccacacaaggtgtttttgaacaacgtgtggctgcattggaagggggagtggcaggacttgcggtagcttccggggctgctgccattacttatgcgtttcagaacattactcgtgcaggtgatcatgttgtagctgcaaagactatttacggaggtacttataacctgctggcgcatacgttgccgacttatggtgtgactgctacatttgtggaccctggtgatctttctaattttgagaaagctattcaggagaatacaaaggcggtgtttatcgagactttggggaatcctaattcgaatattatagatatagaggctgtggcggaaatagcacatcgccatcacatacctttgattattgataacacttttggtactccttatctgattcgtcccatcgagcacggagcagatattgtggtacattccgctacaaaatttattggtggccatggaacttcactgggtggcgtgattgttgattcaggtaaatttgactgggtggcatcaggtaaattccctcaactgacagaaccggatccttgctatcatggggtgcgttttgtagaggcggcaggtccggctgcttatgctgtccgtattcgtgctattttattgcgtgataccggtgcaactatcagtccgtttaatgcttttattctgttgcagggattggagacactttcattgcgtgtggaacgtcatgtagagaatgcgttgaaagtggtggagcatttgaaaaatcatccgaagatcaagaaagtaaatcacccttccttgccggaacatcctgaccatgctctgtatcagcgttatttccccaatggagctagttctattttcactatcgaagtgaaaggtggtcaggaagaagcacatcgtttcatcgatagtttggaaatcttttctttattggccaatgtcgccgatgtgaagtcattggttatccatcctgccagtaccactcactcccagttgaatgcggaagaattggcggaacagggtatttatccggggacagtgcgtttatcaataggtacggaacatatagatgatttgctggccgatttggatcaggcattagctggaatttaataagatatactatatatagaataaggaatattactacaatataaaatcaatatatggataagaagtgtatgccggaggtttgtgtaaagatacattatacaggcttctggcattactttatttctactgataaaaaaggatagatcattaatccaaataggattcttttttgttattaaaaaaagagtctttgcggaagtgggatttcaaaggcttaatttaaagagtttatggataccgtttctttaacttaaatataatggttatgaatctagtccttgctattattccggtattgttattgattatcctgatggcgttttttaaaatgtccggtgacaaaagtagtgtgatttcccttgtcgttactatgctgattgcttttttcggctttcattttccggtaaacgatttgctgtcttcttttctgtatggtgcattgaaagctgtttctcctattctgattattattttgatggcgatattcagctataatgttttattgaagactgaaaaaatggagattatcaagcaacagttttcttctatttctaccgataaaagtattcaggtattgctgttgacatggggatttggcggcttgcttgaagctatggcaggatttggtacggcagtggctatacctgcggcgattcttgtcagtctcggattcaaaccggtcttttcggcaacagtcagtttgattgccaatagtgtggctactgcttttggggctattggtacaccggtcttggtattggcgaaagaaacgaatctggatgtattggtgctaagcgccaatgtcgtgttgcagctttcggtactgatgtttctcattcctttcgtattgctgttcctgaccgattcgaaattaaaatccttacctaaaaatattttcctgtctttgttggtcggtggtgtctcattaggcagccagtatattgccgcccgctatatgggggcggagtctccggctattattggaagtattttatctatcattgttattgtagcctatggcaaactgactgcttctaaagaggaaaaagcaaggaaaagcacattgaaagggctagaggtactgaacgcgtggagtatctatcttcttatcttgttcttgattgttctgactagtccgttgtttcccggtttacgtacaacacttgaaaataattgggtgacccgtatcagtcttccgattaatgattcaactatgaattatacggtttcttggctgacccatgcgggagttttactttttgtaggcacgtttgtcggcgggctgatacagggagccaagatatgggagctgtttgctgtactctggaatacggtaaagcagttaaagaaaacttttatcacggtaatttgtctggtgagtttgtccactatcatggatacggcaggtatgatttcagttatagccactgctttggcagttgctacaggaagtctttatccgttgtttgcccctgttataggttgcctgggtacctttattacgggcagtgacacttcttcaaatattttgttcggcaaattacaggctaatgtggccgggcatattcaagtaagtcccgactggttgtcggcagccaatacggtgggggcgacaggtggaaaaataatttctccgcaaagtatcgctattgccacttctgccggaaaccaacagggaaaagaaggagaaatcctaaaatccgccattccatatgcattggcgtatgtgttgataaccggagtgattgtttatattttcagctgataatcgtttgtaaattcaagagggcgttttaatattgcctgttatggattgaaataccctgtaaacgaggatcaactgttgaaaaatcgtaaaaaaagagatggataggagatttattgccaaaaaagaatttaatttgaaccgttttataatttataaaaaaaagaacatgaacgaattaattgctaaaatcaaagaattgaacgaagcttttatgtctgatgcagcattgcagattgaaaaaggtaacaaagctgcaggaacacgcgcacgtaaagcatcattggaattggaaaaactgatgaaagaatttagaaaagcatctttggaagcttctaaataatccttcattcgtcttttaaagatttttataagccatccttcggggtggctttcttattttctaccaggttttgcttttatttcgggggataattgatatttttgtatttttattggtgggtggttaacctaaaggagaagggatgtttatgaagaatatgtgtctattgcctgtatgggcggttttattgattatagcagggactttcttttcttgtgaaaagaagaaggatatggctatataccgtcaggcggattctttgaacttgctttcttatcgtatgcgctataaaaatttggacacagcgtgtaaagcggcgcatgacgcctacaaactggcggatggattcccctccctgcgtgccggggcattgaataatcagggtttctgcgcctttatccacatggactttgaaaaagccgaagatctttttcttcgcgtatatgaggaatcaaacaatgaattggaatgtttgatagcagatatcggtatgatgaaaatttgtcagcgtaccgccatgaacaaggagttctatgattatcgtaacagtgcgttacggcgtatgaagcgtatcagtgatgaccgttctgctataaccgatcccggagagctggagcggcttaattatgcccgttccgagtttttcattgcttctgccatctattactattatttgcagcaggaacagcagtctttggaggcgattaatgaaataaaagtagacgaggcgctggaaagtgatactgcccaattgctctattattattatatgaaagggtctggcggtatgtatgaagcggatacaccgcaggatgtggtattgggtgagtttaactatctgatagaatgtctgggtatcagcagggaatacgggtatgtctatttcgaggcgaatgcatctcaggcaatggcagaattgctgaaagagaggaaaaatttcgatttgataatggaaaggcgtcccaatgtgatgcgtgccatcaatagcgaggacttgtcgtgggaggaattgaccatgcgttttgcctggcaggctttggatttgttcaaaaaatatggagatttgtatcagatttcgggtacataccgcactttggcgtcgtgcagcaacgagcaaggcaggtatgaagacgcgctgcattacttgtcggaagcactggggtacgtcaatcggcatcacgagaaatattaccattgtacggataccatggacaggctacgtccgtatgttcccatggctaccacttccattgaactggaatggattaatgacgatggtataaaaagtgttcccgaatggattgcccgtttccgtgaacaattgagtgtaacatatgcagcgttaggaatgaaaccccagtcggattataatcgtaatatttatctggatattttggactacacccgccaggacaaagaattggagagccgttataatgcgttggagaaggaatcggaagccttgaacggacttctggtggtagtggtgattggtatcgttgtccttatcattctattttggatattgaataaaagatggcgtgtgcggaatgctctttatattgataagttgaaacgtactttggaaatatgccgtaagataacggcttccgtacccattgatgcgggggagatagaggatgtgacaaaagcggtagttgcctcggtgaaagaggatatcctttcgttggtgggagcgacggacttccgtattgtggctgaaaatggagaggggaatgaggtgccggggcaagggatttgtacaagttttatcttgaatattccgggcagggaacaacctttgggcgaggtgcacctgtattcggagcacaaaatgaagaaagatgataaagcactgatgagggtcattacaccttacatttcgtggacactggagaatggactggcttttatttcgttgggcgatgaacggaaacggctggaaaaggagcaatatgtccatgaacagcatttggcggagaataaacggcagaatctggtgaagaaagcctgtctgtttattgtcacaggcattatgccttatatagaccgaatcatgaatgaagtgcataaactaaccgcacacaactacattcagaacgaagaaataaaagaaagcaaataccgttatatcgacgaactgattacccgtatcaatgagtataatgatattttggccttatggattaagatgcggcaggggacactgagtttgaatatagagaattttgagttgaattccctttttgatgtactggtaaaagggcgtaagactttcgagatgaaacaacagactctgaccatagagccgactgccgccattgtgaaagcggataaggctctgacgcttttcatgataaatacattgacggaaaacgcccgtaaatatacgcagccgggaggaaatgtttctgtttatgcgcaggaaacggaatcttacgtggagatttcggtgaaagatgacggtccgggactttcacaggaagatgtggagcgtattctgagtgagaaagtttatgattcgggtaaaatcggattgcagaccagcgaaaatgtcagcgaattgcagaagaataaaggtcacggtttcggtttgatgaattgcaaaggcattattgataaatataagaagaccaatgagatattccgggtctgcctgttccggatagaaagtgaattggggaaaggcagccgtttctatttccgtttgcccaaaggagtgcgcaaaacgttgatgttggtgttggtcgcttttcttcctgtcctggcaggatgtaatgaggggagggagaaagatgggaaagcggaacagctcactgtcaatgattccattcagcgatatgataaattattggctgttgcgaatgaatatgcatacgatgtttacaattgtaacattgatggattatatcaacaggcattgtgttatgcggacagtgctctatattgtttgaataagcattatattatgtattcgggcagcaaagggcctttgttggaattggaaggagagggggtagcagcggatttagattggttcaaccggcattttgataccgattactatgccttgctggatgttcgcaacgaggcagcagtcgcctttttggctttaggtaatctggaggcttatcgttataacaataatgcttatacggcgctgtacaaacagatcagtgaggacacctcattggagcaatattgccgccagatgcagctttctgccaataataagacggtggctatcattctttgtgtggttattttgttggtattgctggtgggatattatattctgtatttccgccaccgtttgatttatcgttataacttggaacaggtgttggaaatcaacaagcaggtgttttcggcctctttgcttgacggaagagccgaccgggatattgctgcaagtctggtcaaggatatgtttgaaacggtaaatgagttgctgcccgttgatgtgttgggcgtagcggtttatagtgaagacaaccacagcttgaattatgctttttcaccggtggaggatgagaatgaagaaatgcgtgagatgatggctcgtagttttgacgcgaagacaccttattggcgtgagaaagatagggtaaaatgtttgcccttgtgggtggaagcaggtaacgagaatcgttgcacgggtgtgctggcattgaaaatcgctttgcctgtggagcgtgaggacgaccgcttgatgctggagcttgtggccggatatgtagccatcattgtatataatgcagtggtactgatggcgcagaaatatcgggatatagaaagtgcgcaggatgatgcgcgccgagccatacgggaggaaaaccagttgcatgtgcaaaatctggtattggacaattgcttgtcaaccattaagcatgagacaatctattatcctaaccggataaaacagattatcgacaggttgaacacccgtcaggctggagaaaacgaagctgtgcaagtagaaacgattggtgagttgatcagttattataaggatatatttactttgctgagttcatgcgccgcacgtcagttggaagaaattactttccgcagaggtgttgtgaaagccggcgaactggccgattatgcggtacggtatataaaacgtgctggaaaacgtatgccgcatcgggtagaactgaggacggaggtggaacatgtttccgtattgggagatgtcattcagctgaagtttatgttggagaatttaatagatgaagcgctatcatacgaggtggatggtattttggaattgtgtatttataaggataaggattttgtgcggtttgatttccgcgatacgcgtcgcgaaaagtcgcaggaggagttgaacttgttgttctacccgcatctgtctcgtatgaagcaggggcaggaaggagttctgaccggtacggaataccttatttgtaagcaggtgattcgtgaccatgatgaatttgccggaagacgcggttgccgtatcaatgcgcagcctgccgctgaaggagggttcaccgtatggttcaccctgcctgcccgttgaatgtagaatgtaaaaaaacaatgcatattatggagaataatagatttaaagtcatcattgtagaggatgtcaaactggaattaaaaggaacggaagagatattcagacacgaaattccgaatgcggaagtcatcggaacggctatgactgagaatgagttttgggaattgctgaaagtgcagttgcccgatatggttttattggacttgggcttggggggatcgactaccatcggtgtggaaatctgttcttctttacggaagaactatccggatatgaaggtgctgatttttactggtgaggtattgaacgaaaagttatgggtggatgcgctgaatgcgggtgcggatggtataatcctgaagacgggagagttgctgactgccacagatgtacaggcggtgatggatggcaagaaactggttttcaattatcccattctggagaaaatagtggcacgtttcaagcagtcggtggctcaggaacagcgcaggcaggaagctgtcattaattatgatattgatgaatatgatgagcgtttgcttcgccatctggccttggggtataccaaagaaatgattactaatctgaaagggatgcctttcggggtcaaatccatagagaagcgtcagaatgaattgataaaccgtttgttcacattggatgaaagaagtggtgtcaatgcctgtcgattggtgacccgtgctttcgagttgcggattcttgacattgataatttggaaccggatgaagagtaaatattattttcctcataccgctactgtgttttttctgctgacggtagctgtagccttgttctcatggataggaagtatttatgggctggggaaggtgcaaagcctgctcagtcccgaaggaatccggtgggaattgaggcatgctatggggaattttgtccagacaccggcattgggcatagtaatgatgctttttttagggttcggcattacggttcattccggggtatggggtacgttggggaggatagtgaaaagaggaaagcccatttcccgtaaggaaaaacgtgcgttgatattggcaggttgtatactgcttgtttatatcataatgattatttgcaccacttttgccccatggactatgttgcgtagcgtgacgggatctctcacgaactctccgtttcaaaaagggatttattatctcatttcgtttggtgtgggattgtcgggtatggctttcggttatgcatcgggacgttttcgggatgataaggatataataaaaggtatgtcctgtctcttttctcgttttgccgattactttgtggtgcttttttttatagttcagttcttttcttcattgatgtatacgaatttggtggaatgggttggaatagattcatatatagtgtcttacgctttccatatttgttgctatttaccttttgcttggatgctgaatagaaaaaaaatagattgttaatgcaaaaaagttgcggattcttttggtaatttcaataaaaaccgtacctttgcactcgcaattaaggatggttccgtagctcagctggatagagcaacgcccttctaaggcgtgggtcttgcgttcgaatcgcaacggaatcacataaaaaaagctgtatcttctgagggtacagctttttttatggaaatatttaaaaaggatttatctataagcggggctatggaaaagatcttgtccatatctataaacctttcccgttggatagttaagggttttcttcctgtttgttctatctccgcaagcctttggagttaactccatagccttgggagataactccaaagcttatggagataactccaaaggctatggagatagaatacatccgtataaaaaggtttaatctggaaagagaaaaggtttatgcaacaggaacagatgcaatacattgttgtttaattccgctggcgggctattactttttctcagtttctccgccctttgggcttcatggcagcggaaagattgaaccggttaaaaagtcatgttaaccctttttgtacgcgtaacttccatgtatgcaggcgaggggatggataaccattattttactgaggtgcatgatatttatgtaaaggatttgaaatgcaaaaaggtgaatgtagctgcattggtgcttcaaggcacagaggagaagcctatttataacgtgacttttgataacgtggatgtggataaagcagggataggtcttggtttctcgaatacgaagacaattggggtttctaattgtaattgggaggttatgttggggtgccgtctacagccagtgcgaaagatggtatattcgataaatagatttgtttgacttcttggtttacttcgccgattccttgaaagattcttgttacgctggaatgacagagtaaaaggaaagcaggaaaccgtttccggacaggctgggggaggatttttcatccctcagctaaacaaatgtttttatagatggttctataagtaaaaagacgataattatgagtacaaacgaatttgcccgaattttattgacttggattaagagttttctatcatggataggcatcccgcgcgataggttgaatgaactggatgagattattttcttgatcctgattgtggttattgcttttgctgtaggagctgtttttcattatttatctgtgcgtttcacacggaaggtgttgaaatataaaaatatcagttttttaagttcgctgatagaatacaatgccttgcggaaaatgtctgcggtcattccgccgcttattatatccgctttgttgccgtttgtgttcgattatcgttctacttggtttactgtcagtgaaaaaatcacttggatttatttctttatcgctttgttgttttcggtcaatgccgtgttaaactcggtaggtaatgtgctgatgaacaaggagcagttacagaatcgtccgatgaaaggtttcatacagatctttcaagtgattttttcgtgtgttgccatcattgtcatcatttccatattgattaataagtcgcctctcaacctgattaccggactgggtgcttttgctgccgtactgatgttgattttcaaagataccatccttggctttgtggcgggggtactgctttccgagaatgatatggtgcatatcggcgattggattgagatgccgcagaataatgtgaatggggtggtgatggatatcactctgaacattgtgaaggttcagaatttcgataatactattgtcactatacctccttattcattagtctccggttcatttatcaattggcgtgggatgactgaatcgggcgggcggcgtattatgcgcgagtatgcattgaaactggattacatacaaccctgtactcctgaatttttggagaaaatgaagaagtttgatgctgatttggccgactttatcacagaaaagcagaaacaggcggctgaaggaaaagtagcgaatactgacaatccggccggattggtaaatggaaccatcgatacgaatgtagggctgcttcgtgcttatatgactctctatctgaagcgccatccttttatcagtaaggacctgttgctgatggtgcgcacgttggctcctacggagaatggtctgcccgtacaaatttattgtttctcgtccaataagaactggcctagttatgaatctatccaggcggaaatcatggaacattttgtttctgttcttcccgagtttggattgtatccgttccagaatcctactgccagagattatgtaatcagtggtttgatagagtctggcaaggacctttctactgtagacggaattccttggcattcggtcttgccaaaggaagaaaaggtatagttagggatttaaacatttattaatgacttgcggttgaacaattcttgttgccgccgtgttatataaatgtgtttttcatagtattagattaaaggttgaagattgcaatcggcttgagagaagtagttgcatctgaagtagaagcgtctactataaaaaatatagaaaggttgttccttacgggacagcctttttgttttgttaaaagaaaccattcactttaacttgaaatgttaaaggagttgttgcttttattaaacaattctataatttcttcttaacgcttccttaaatttgcagatagcaggaaagtgtgtatatttgcatgtgtgtttttcatagtattagatttaaggttaacaaaaggttggagcaaggcgttgctcctttttttatggagtaacgtgaggagtacatctgctgtccggttccgatatccgatacagaaccacagagaagaatccgtgcaatgtattcctctccgtgactgtgtaacttaattctgcatttttaatgcaagaggcaggctgaattaaataatctcgatgccttgcttccggcataactccaatcccacatcctttaacttgaatttctgtatctttccgctgcccgtcatggggaactcatcaacaaagaagatatatttaggaattttgtaacgggctatcttgccgtcgcaaaagtcacgtatatcgaattcgttcatttccaccccttcgtgcaagataatgaatgcgcctaccgcttctccgtatttcttggaggggataccggctacctgtacatcttttattccttccatctgatacaggaactcttctatttcccgtggatagatattctctccgccacggataatcatgtcttttatccgtcctgtgatacgataattaccttcttcgtctttcactcccagatctcctgagtggagaaagccgttccggtctatcacttcggcggttgcttcggggtttttgtaatatcccttcatggtgttataccctttgttgcacatctcgccttgtacgcctatgggacattcctcgccagtttccggatcgatcacttttacttccgtaaactcgaaatcacggcccaccgtgttgcagcgtacatcaaacgaatcgtcgatgcgggaggctgtcatgccgggagaagcttctgtaagcccgtatacactggtgaccttcataaacattttctcttccacacgtttcatcagttccaccggacagagtgagcctgccataatgccggtgcgcagactggacatatcgaacatatcaaacatgggatggttcagctcggcaatgaacatggtaggaaccccgtacaaggccgtgcagcgttccttgtggacggaggcaagtaccagcagcgggtcaaaacgttccaccatcacctgcgtgcatccgtgtgtaaggcagttcatggtggctaataccactccgaagcaatggaacaggggtacacagacacatagtttgtcatcggaagtgaatttcatgtgctcgccagtcaggaaaccgttgttgctgatgttgtaatgggtgagcatgactcctttggggaaaccggtcgtgcccgaagtgtactgcatgttcaccgtgtcgtggcagttcaccttcgctttcgcttccagcagctcgtcatcgtctatgttgcatcccagaagcagaatttcggcggtgttgtacataccccggtatttttcggggccgatgtaaatcacgttcttcatgcaggggaagcgtttgctcttcagatatccgcgctggctggtctttagttcgggcagcatggcgtagaccatatttacatagtcgtcattgccacggtctccgtttacgatacacagcgtgtgcatatccgagttctggcagaggtattccagttctgcctgtttgtagttggtatttactgttacggccacggcgccgattttggcgcaagcgtacagaaaggtcagccagtcgggcacattacccgcccagatccctacatgggttccccgtttcacgccgatggcgagcagtcctttggccatgtggtctacacgctcgttaaattgtttccaggtgaagcgcagattgcggtcggaatatacgatatattctttatcgggagtggtgagggcccaatgttcaagccagtcacccaaggttctcgtgcttaattccatcataaatcaaataggagtatagataacagccaatattttggcggcttgtccttgatatccgtgtacgtggtgcggaacgatagaatcataataaatactgtctccggctttaatcagatggcattttttaccatggcatacttcgacggcgccttccatgacatagataaactcttcaccttcatgcgaggagagtgagaagtggctttcctccgtcggttccacgtctacgatgaatggttccatatgcctgtccgcttttgattttgacagtgagtggtagcgcatatgtgtacgcaggtccattgcattgttcgagaaactgatggtatcctcactctcttgtttccggcagattactgctccttgttcttcctggtcgtccagaaaagtgcccagacgtacccctaacgcgcgggctatcttgatgaggggagccaatgaaggaagatctacattattctctattcgttctatttgttcttcggcaaggccagagcgtacggccagttcggccacactgatttcttttgtttcacgtagtgattttattttttcaccaacaatctttgtgctgtccatggtttgtttttaataagtttgcaaagtataaagtgcaaatatataataaaaaagaattgggcactctgtttttgttctgaatatgtaaaaaaggcaggttagcgacgaattgccggtcatttgtcattaaccgtcggtaagtttcgaatatttgtgttttttgttctatctttgttctcgaaacttaattaaagactaaaacttatgttctcagggattgtagaagaatatgcggaggtggtgcgtattgtaaaggagcaggaaaatctgcacctcaccttgaaatgttcgtttgtggacgaactgaaaatagaccaaagtatctctcataacggcgtgtgcctgactgtagtcagtttacaggatggaacgtacacggttaccgccatgaaagaaacgatagagcgttccaacatcggcttgctgaaagtgggagataaagtgaatgtggaacgcagcatgatgatgaacgggcggctggacggtcatattgtgcaaggacatgtggatcagactgccgaatgtatggatataaaggatgctgaaggaagctggtattttactttcagatatgcgtttgacaaggaaatggcaaagcgcggctacatcacggtggacaaaggctcggttacggtgaatggtgtgagtctgaccgtttgtaaccctacggaggatacttttcaggttgccatcattccttatacttacgaacataccaatttccatacttttaaagtgggaagcattgtgaatatagagtttgatatcatcggcaaatatttaagccgcatgatgcagttctcctgattcttttaccgcaggttgcacagatgattgttgaagatgaaagaaacttctttgtggaaatccggaattatccgcatcggcttttgagcaaaaaagaatctgtgcaatctgtggtaaaatcgaatatcagaattataaatctttcagcaatatcttgctggtgcttttataatattcttcacgggcatttgccagcgcctcccaagaactgctgtatcgctttttgtctattttgaaggcttccgttccggctatgtccagtctgttcagcagcatagccacgttcatccggttgatatctactgacggcaaatagcctatgctttcatcgtcaccgtccatagcagtttcataaatcatgtgcatgtcctgtagttcatacaggattttcttggtgagccttatcgggattttatgttcgtcgctgagtgtctcggcggtataaggagcctcttccgtctcaaagcgcttgcatatcagagacatgatgaggatacacagaaagtcgtgataacggcggctgatatttgccgtttctttgctgaaactgtagttgcgaagattctgtgccacatagcaaagttctgcgccatacaggcagattccccatgaaatttgcgcccataacaagaacataggaatggcggcgaagctaccatagattgcattgtaccttgatacccatatctgactgccgatatacaagtattgaaaagcctgaaaggctgtgcctgcgatgatacccggaatgatggcatacttcagtttcactttagtattgggcataaagacgaacagtcccgtaaacatggcccaagtcaggatgaaagggatcaggcgtaccagaaatttcatcaggggtgccagtaatacgaagtcctccatgtttttcaccatggtggacataaagatggtaagaccgctggaaagtacgataagtaggggcagtaagagcaggatggagaaataatccgtcattttgcgatacagtgtacggggcttcttcacttgccatatataattgaaggtacgttctatgttataggtcaggctcagaatggtccagaacaacatcaccagacccactccgataaaaattccgcttttggcgtgcaccagataggagtcaatcaggccaagaatggtttcggcagccgcactctgtccttcaagaccgctacggaattgggtttccagcaggttggagaagccgaaaccgcgtgcgatggcgaataaaatggccagaatgggaataatagaaagcagggtgctgtatgtcagtgcggatgctttattcaaaatacgtccctgagtgaattcacgaacagaaagagtagcgatttttattgcattatagagtattcctcgggatttgctaacctcgtcttctgtcacccgccatatatcatctttgagaaacgattgcagacctttcagtttttccttgttcatggtactcataagctcttcattaggatatatgaaaaaaaagcagccggcctgtaagccgggttctgttcttcgccttgcggcgaagtgcctgccatttatctacgcctgttgtcaccaacaggctctagcggtctaccctccgacgtggggcgagcaaccctcataatgtcggtttacatgaccttacaactcctaagacgtacagcccgtcatgtcaccatgcggctggtaggctcttaccccaccttctcacccttaccccgtttcccgtaggaattgtggcggttgttttcttctacgttactccaccttcgcagatggctttctgttaggaagtaggatgctctgcgttgcccggactttcctctttcgccttacggcgtcagcggcagaccggccggctgcttttaagtctacaaagatagtgattttaggttaaacgtaggataataaagcggaaaaaagtaagaaaataaatggaaaaacgaagaaagagcggaacagcccattactttttcttggtatatataataatgagaagagaatcggtgatgctcggttcggcactcctgcttatcgtatagaaacaacggtaaaaacagaaatataaaagtaaatgaacagtgccggaaagagaagtgggtgcagttttcgctttccctctccggacacggattttagcggtagaattccagttcgtttcttaatgaacgcacttcctgttgcagaagttctatacgttccagcatgtggtgaatggcgtcgattcctgcaatattgatggacaagtcataatataaatgcgtgtaacgctccagttccgctagttgggatgtggggaggtagcgttcctcgtcaatcacccggacttcgatcagtccgtcttcttccagttccataatgaacgacgggtccacatggcaacggtcgcaaaaatcgttgataataattaaatcggtctgcataatccttctctttttttaattgctactatcttttaattggcggaacagctctttctgatgttcggtcaggttgctaggaatggtgacattataagttactatcagatcgccaaatttgccttcttccttgtaaacaggaaagcctttgcctttcaaacggactttggttccgttctgggtttcaggttttactttcagttttaccttgccgttcagtgtgtccacggtttcttcaccacccagtacggcggtgtagaggctaagcggagcatggatatataaatcatttcccagacgtttgaatacaggatcgtctggaatgacaaaggtgatgtacagatcgcctgcaggaccaccgtttacccccggtgcaccatgaccacgcaatttgatagtctgtccgttggctatacctgccggaacagtgatacgtatgttctttccgtttacattaagcacttgtttgtgtgtttcggcggcttcacgcaatgaaagttgtaattcagcattatagtcctgtccacggaatccggcgcttcgtccgccgtttgcaccgccacgatgcccgaacagttcttcaaagaaatcagagaaaccacctgcgctgccaccgaaatgtgcaccggtgaattcttctcctccattgccggaataccagtaactgccgttaccgtccgtaccgaatccgcttccggctccgccaaaccctccgaatccaccagcacctccatattgttgcttttgtttttcaaattcgtcggcatgtttccagtgttccccgtattcgtcgtatttcttacgtttttccgggtcactcagtacttcgttggcttcatttatctcctgaaacttatctttggctccaggatcattcggattcaagtcaggatggtatttgcgggccagcttacggaaagccttcttgatatcatcttgggtggcacttttgtccactcccaatactttgtaatagtctatgtaagccatattatatatttgttaaatttcatctgctttaagagaaacaaaatacatgccaattggttgtgttctgtttttattttattatctttgcagcgaatttttagaaattattctaaaggaaatgaggggattggcaatcatattcaggttttttatgctattagtcctgctgcttcctgtggttgctctgtgtcctgtgaaggcggaaacgacctcggaagggcctatccttattgtcacttcttataatcccgaaacgcgtagtatttctgacaacctgtctgcttttatggatgaatacagacagcgtggcggcaagtatactccgatcatagagagtatgaactgcaagaatttgtccgaggcctatctgtggaaatcgcgtatggcctccatccttggtaagtataaggggaaaaaccgtccgtcactggttatattgttggggcaggaggcatggtcggcttatatctcacaagacacggagatagctaaaaagactccgtctatctgtggcatggtcagtgtcaacggactggtattgcccgatgatagtatcgacacgcgggtatgggaacctgaaagtaagaatatttatacggatttcagtgattataatattgttgccggttatgtatatgaatatgatgtcgataaaaacataaagctgatgcgtcgtttttatcctgatatgcgccgtgtggcatttatatcggataatacctatggcgggttgtctatgcaagccttggttaaaaaggagatgaagaagtaccccgatttagaaacaatttggctggacggccgtacggaaacctttatggaagtgagtgaaaggatgcgcaggttgcctcaaaatacgtgtgtgttattgggaacatggcgtgtagactgtacggagagttatgttattggtaatacgacttatatgctgcgcgatgcgaatcccaccctgcctgtgtttactattgcatctgtggggctgggacattgggcattgggaggatatactcccgagtaccatgcggtaggaaagaatataggcgcggttacttatgattttttggataaaggggatagagaaggggtggacttggtgactattcccggaaactatacttttgatataaagcgtttgcatgaattcaaattggattcattgaatcttcctcagggagcggtgttggtgaacaagactccttcgttttatgagcagtataaatattgggtcataggggttgtttcggcgttcatgttcctgatagcctgtttcttgatagccatatattatattatccgtatcaaccacttgaaacataatctggaagtatccggcgaggaactgctggtagccaaggagaaagcggaggaatccaacaggctgaagacggcttttctggccaatatgagtcacgaaatacgcactcccttgaatgccattgtgggattttccagcgtgttggtcagtgatgattcctctcctgccgagaaagagcagtattgtgatatcattcagaagaattccgatttgttgttgcacctcataaatgatattctggacatctcgcgcatggaatccggaaggataaaattcgtatgggaagaatgtgatgtggtagagttgtgtcagacggctttgtctacagtggagtatggacgcaagaccagtgctttgtttctgtttgaaactcctgtgccttcgctggttgtcaagacggatgcccagcgtctgaagcaggtgttgattaatttgctgtccaatgccgcaaaatttactccgtccggttctatcaaactgacggttgccatagacaaacagcatcagcagttggaattgtcagtgtcggataccggttgcggtattccacccgataagagtgaaaaggtatttgaacgtttcgaaaaattgaatgaatattcccaaggtacggggctgggattggccattagcaggctgataatcgagaatctgggaggtaagatatgggtggacaaggattataccgaaggcgcccggtttgtattcacgcatcctttgactaaaaaagaaaaagagtagagaaatgaaatatagaatatgtatcagcgccctgctgttgtgggcgggtatgcagttgtctgcatccaataatcagaaagaagtggttatcaagattatagaaaccagtgatgtgcacgggaatttctttccgtataactttatcgaacggaaagaatggagtggaagtcttgcccgtgttcattcctttgtgaaagaacagcgtgagaaatatggggataattgcctgttgatggataatggggatatcctgcaaggtcagcctacagcttactattataatttcatggataccgtgtctactcatgttgcggcggatatgatgaattatatgggatatgtggtaggtaatatgggtaaccatgatgtagagactgggcatgcggtgtacgaccgttggataaaacagtgcgattttccggtactgggggctaacataatagacaatgccactggaaaaccttatctgaaaccctacgaggtgttggagcgcgacggagtgaggatagcggttctgggtatgattactccggccattccttcatggttgccggagaaattatggagtggtctgcattttgaggaaatggagccctgtgcacgcaaatgggtgaagattataaaggaaaaagagaatcctgatgtcattgtgggattgtttcatgccggaaagtcgggcaacgtgttgggacaggtggtggaagatgcctctatggatgtagccaaacgggttccgggctttgatgtggtgctgatggggcacgaccatactagggaatgtgtaaaggtgcagaatgtggcaggagacagcgtgttggttattgacccggcaaacaatgccaatgtagtttcggatgtgaccctgaccgtaacaaagaaagacgggaaagtagtggagaagtcggtggaaggtagattggcggatatgaacaagtatcctgtcagccgggagtttatggataagtttgcccctcaatacaaggctgtaaatgactttgtatcccgtaaaatcggtacaatttcacgtaccatcacagcgaaggatgcttatttcggttcttctcctttcatagacctgattcatcagttgcaattggaaatttcgggtgctgaagtgtctttctgtgctccgttgtccttccgagcagagattaaagaaggagacatctatgtgagtgatatgttcaatttgtacaagtacgagaacatgctgtatgtgatggaactttcgggcaaggaaattaaaggtttcctggaaatggcatacgccatttggactaatcagatgaagagttccgaggaccacctgatgcttttcaaggagccggtagaggagggaaagcgtgctaatttcaagaatttcagctttaactttgactctgccgcaggcattaattatacggtggacgtgaccaagccggcaggagagaaaatcacgattcagagcatgtcggacgggactcctttcagtatggataaggtttataaagtggctttgaattcttaccgtgggaacggtggcggagatttactgactcttggagctggaatttccaaggaagatttggcaaaacgtattatttttgcaaccgataaggatttgcgttattatctgatgcaatatattgagcaggaaaaagtgctgcatcctcatgctatgcaccagtggaagtttattccggaggaatggactgtgcctgccgcgaaaaaagactatcaattgttgtttggcgaggaaaagaaataaatagttgagcaagagaaggtacatagtagccccgttattactgctggcgctgtttttaacgtatcaggtaagcatcactttgtttacccacgttcatattgtgaacggggtgatgattgtgcactctcatccttcgtccgaaaaacaccatacgcataccacaggacaggtaatcttaattgctcatctgagcactatccagactctggagcccggggggcagacagagatgactgtattccgtcctgtgttgtatgttttggaatacaagacaaatactttccgcgcgaaagcgctttgtgcgcaatgtatccatttgcgcgctcctcctttttattgctgaaacataaggtatatctgttgacgggatacattcggataatccgttcaacagatgcggatgtgcttttgccgtagagctgcacacattctttaattgaataaaccgaaacattttagtaatagaaaaaatagatgaaacaatatattctgttactcgtgctcatggtgatgggtgcgggtatccatgcgtatgcagaagatgtaaatcctgtgaaggaaggaaatgtgatttcaggtcatgtagtggaaaaaggcacggagaacagccttccgtatgctaccatattgattgtggaaaccgggcaaggtacggtgagtaacgaggacggggagttccgtttcaagaaggttccggcaggaaagtacacattgagagttcagctactgggctatgagacacaggaaaagaaagtgaccgtcagtaacgacttcacggtagatgttcattttttgatgagtgacgaaagtattatgacggacgaggtagtcgtatcggccaatcgcaatgaaacaagtcgcaaggtggctccggtggtagttaatgtgatgaatgccaagctgttcgaatcggtgaattctaccgatttggctaaatccttgaattaccagtcggggttgcgtgtggagaacaactgccagaactgcggcttccctcaagtgcgtatcaatgggctggaaggaccttattctcagattcttatcaatagccgtccggtagtcagtgctctgtccggtgtgtatggcttggagcagattccggtgaatatgatagagcgtgtagaggttgtccgcggaggagggtcagccttgtttggtgctaatgcagtgggcggaaccatcaatatcatcacgaaagatcccatcaacaattcatttcaggtttcttcaacaatgtccaatatgaacggcaaggtgtgggaacagtatatgggagccaacgcctctttggtgtcaaaagacaatacgtatggcatcgctttgtatcagtcttatcggaaccgtaatccgtatgatgcggacggggacggtttctcggagttgggaaagctgaatatgaatacattcgggctgcgcacctattaccgtcctacgcagttcagccgtatcagtctggaatatcataccacgaatgagttccgccgcggagggaataaatttgatttgcagccgcacgaaacggatatcaccgaacagaccaagcacgtcatcaatagtggcggattgagttatgatctgttttggaaagaatacaagcataagctttctttctattcttccatccagcataccgaccgtaacagttattatggtgcgcaacaggatgcgaatgcatacggaaagacgaaagatctgacttgggtggcaggcggcatgtatgtgggtaattttgagaaagttttattctctcctgctacttttaccgccgggctggagtatcagaacaactccctgcacgatgttatgaccggttatcaccgtgatatgaaacaggatgtgcgcattgccagcgcttttgtgcagaacgaatggaaaatgaatcagtttgtattcctggcagggttccgtctggatgaccataacctgattgacaatcccatcttcagcccccgtctgaacctgctctataagcccagtgacaaactacaggcacgtattacctggtctaccggtttccgtgcgccgcaggcatacgatgaggatttgcacgttacggcagtaggaggtgagggcgtgcttatcaagttggcggaagggctgaagcctgagcattcgaacagtatcagcggttccattgattggacggcgaatattggtcatttccagaccaatttgttattggaagggttctataccggattggatgacgtgtttgtactggaggatatgggccatgacgagaatggtaacaaggtgaaggagcgtcgtaacggtaacggggcacgtgtgtatggcgtgaatctggacggaaagattgcacatggacgtgatgcggctttacaggtgggcttcacggtgcagcgcagcgaatatactgagctggaggcatggagtgagaatcctgaggtagcgccggtgaagcggatgccccgtactcctgactattacggttatttcacattgacatctgctccgttcaagaatttcgactgctccttgtccggtgtgtacacaggccggatgcatgtgccgcatttcgcaccgacagagttgcccgaggaatatataggacaatatatcgctaaagatgaaatggtgcatactcctgatttctttgatttgaatgtgaaactgaattatacgtttgtattgaatgaccatatcaagttgcaattgaacggtggagtgcagaatatctttaatgctttccaaaaggatttggacaaaggtggttatcgtgactcgggttatttctatgggcctacacagcctagaacgtattttgtggggatcaagattacgaattgaataatctgctgattggtcaatgtgctaatatgtcaatgggttacgctttgttccacatggcacattagcacattgtcacattgacaaattagcagattgatttattaccaactactgacaagtgactatacttttctgtaatccggaatcccggatcgggataattatataaggggaagcggtgttctgtttctccttccatatatttccacagactggcatattcttctttcttctcgcccatttcctgcaattgcagcatatattgccagatagacttgttttccttgatgtatatttttttcatctgatgaataatcggactatgctggcgggttgggtcatggtcaaattccagtatccgttttccctcttttgtcataccgatagttacgaaagtcatgctcttgcctatacccggcaggttcagtacgctgcggtctgttgctacgaaaggaatctgatggaaggtgcagaaacgctgtacggctgccgcacggtctttactgtttctcaacaggttcaagaactccttttcttgctctgcggagagttttccccataccttttcctcttctttctcctgcaaggagcggctgttaggtgcaaatacggcataattctcctcaaatccttttaccgagaaggtgtaatagcatagtacacccagcccattcaatactttgcgcagcttggcggtgtgtccgcgacgggaagcagccacattatatactaactggttggtgatagtccacccggctgccagtatcttgcggatagcttcacgcgcttcgggtgttacttccagcggagtctggaaatgcgtttgaatcagaaattggctgactcctacggcagatgccttttctttgaactcgcgtaagatttccaatagctcgtcattgattcgcatgggcagatataccgggagccggctgcccaagcgtactcgttgcagttccgcatatttctctccttcggcgcggtgcaggtttgcgttccgtttgcggacagccattttgtagacggctttcagtatattgcgcagggtcttgttctggctcatcaatgcatcgcctcctgtaatcaggatatccctgagctgagtgtcgttctcgaaatattccatcagttttctcaacctcttgtcccagctctctttcggcttcaattcctcgaagttgaagttcagacgttcactttgaaagtcgtacatgcgctggcaggatgcacataggccgccgcaggcacgtcccatcgagtcggggataagaatggccacatcgggataacggcggtgaatgttgtgtccgtccggcagcagccatccggcagcgttgggctttccgtcctctactgcatcttctttttcccatgcgtggatgttaccgtaagtttctaccaattgggaagagtacaagatatagctgcgtatggcttcgtcatcatatccttttccggtaggattcaataatgacaaataataaggggtgatgaagacaggcattcctttcttgcgtgctttgtgataaagctgcaaggtttcttcggacaaggagttgcctagcatccggttcagttcggtagggctttttacggccattgccagatgaaaacgggcttcgttccaccattggcagaccagccggcgtttatcctcttccgtgcttccttcaggaaaaaggtagcggctggagggtgcgtgtctgttttctattttctggataagaagggagatgatacgttctttgttttgtcggcggatagcccggacatcctcattcagtccgctgggccagcgtttcatccactgttgcacttgtttttcatcaggtagctcctcttcttcgtgataaagccggtcgaactggtgatacaggtcaatccataaatcaacggaaatctcttcattgatgatacgattcgttaaaaacttccaaagcagtgagatggtttctattttaatctcctgttctgtagaggcttcgtaaatggtttttccatcgttatctatcagtcttttaatttgccttgcggcagcaggattgtaaataggaccggataatagataatcgttcagcttgtttttgaaagctgtttcatcctggctttctgaagccaatgaagtgagttgggttaatcgggtttcgaatagtgttttaatgccatgggtggataacatcttattcttttgtttcataagcaaacggttgttaagaaagtgaatactataaataacatatttctcgtagaaaagttatcaaactgttaacttcatgctgctaatatagtaaaaaagcttcttttatgcaaattcattaacaaaaagactctttttataaatagcattattttatagagtacatttgctttgtgctttcgtctttttttaaagcccggagcttttatcgggaaacgaagaaattcgtagttttgtagagctttgcttgtttgcaggtcaatcaagctgaagagaaacctcattttaataaatggaaaaacaacatagaagtaaataaatggaactgaaacaactttttacctttgcagcagcctgttcgctggcactttcggtatcggcgcaagatagagtacactatacaggcacggagctgtctaaccctacctgtcatgacgggcaattgtcacccgtggtaggggtacacaatattcaggtgatgcgtgccaaccgggaacatcctgcacccgataacggcaatggatggacatacaatcatcagtccatgttggcttattggaacggacaattctatatgcattatctttccgatccttcggacgagcatattcctccctcacaaactttcctgatgacctcgaaagacggttatcactggacaaacccggtgacccttttccctatctaccgggttcccgatggctataccaagcccggacgcacagacaaggcaaaagatctggatgccatcatgcatcagcgtgtaggcttttatgtgtcaaagagcggccgactgatagccatgggaaactatggcgtggcgctggacaagaaagatgatccgaatgacgggaacggaataggccgtgtagttcgcgaaattaaaaaggacggttccttcggccccatttatttcatttattataaccatgcgttcaatgaaaagaatacctcttatccttattttaaacggagtaaagacaaggagtttgtaaaagcctgtcaggagattctggataatccccgctaccgtatgcagtgggtggaggaagccgaccgcaatgacccgttgattcctttacacaaagaatacaaagcgtattgtgactataccttgcccgacggccgtttggtaagcctgtggaaacacgccctgacttccatcagcgaggatggcggaaatacatgggcgcaaccggtggaacgtgcgaaaggtttcgtaaacagtaatgcgaagatatgggggcaacgtttgagtgacggtacatacgccacggtgtataatccttccgagttccgctggccactggctatttcgctgagtaaggacggcctggaatataccactttgaacctggtgcacggcgagattacgccgatgcgttacggaggtaattataaatcattcggtcctcagtatgtacggggtattcaggaaggtaacgggactcctcccgatggtgatttatgggtgacttacagtatgaataaagaggatatgtgggtgtctcatattcctgtgcctgtccgcgcacatgccagcgagcatgctgacgacgattttgccggctacaaagatttgagcgaactgaccgactggaatttgtattccttgcagtgggctcccgtatcactggatggaaaatggctggtgctgcaagacaaggacttattcgattatgcccgtgtggagcgtaagatacctgctacaaaagaactgaaagtatctttcgaactgatggcggaacagaacgataaaggacttttgcagatagaatttctggatgaaaacggcattgcctgttcccgtctggaactgactcccgatggacttttccgtgccaaaggaggtgcgcggtttggtaatttgttgaagtatgaaccgggcaagacgtataaggtagaagtggagctttctgttgccaaccgcatggtaattgtctatgtggatggaaagaaagtggggcaacgtatgttctttgcgcccgttccggccatcgagagagtgatgttccggaccggagcgcaacggacttatcctacggtggataccccggcggactggtatggcattctgccggatgcgggtgagcaggaacccttgtgcacctatcgtatagccaactttaagacggcttctgctgataaggatgccggtgcggctttcttgaaatataaggatttcaagccctatgtggattatttcaacagcatggaggatgagaatatagcccaggctattcccaatgcccgtgcatctcaatggatggaagaaaacattcctcttttcgagtgctctcaaaagaacttcgaggaaatgtattattatcgttggtggacgctgcgcaagcacatcaaggaaactccggtgggctatggtatgaccgaatttctggtaaaccgttcgtatgccgataaatacaatctgatagcttgtgccatcggtcatcatatttatgagagccgctggttgcgtaatccggaatacttgaatcagattatccatacttggtatcggggtaacgaaggaggcccgatggccaaaatgaccaagtttagctcgtggaatgcggatgcggtactgggacgttacatggtcgatggaaacaaggagtttttgttggatatggtaaaggatttggaagcggaatatgcccgttgggaaaagacaaaccgcctgcccaatggactttattggcagggagatgtgcaggatggtatggaagaatccatcagcggaggccgtcgtaagcaatatgcccgtcccactatcaacagttatatgtatggcaatgccaaagcactctctcttatcggcatcatgacaggagatgagggcatggccatgaaatatggattgaaagccgattccattaaaacattggtacaggataagttgtggaacacagaccatcatttctttgaaacgatgcgtggagatgcgtccgccgaggtacgcgaggctatcggctatatcccttggtatttcaatttgccggatgcttcttccaaatacactgtggcatggaaggaagtgatggacgagaaaggtttttccgcaccttacggacttaccactgccgagcgccgtcatcctgagttccgcacgcatggcgtaggtaagtgtgaatgggatggggctatctggccgtttgcatctgcacagactttgaccgcaatggccaatttcatgaataattatcctcagactgtattgacagatagcgtgtatttccatcaaatggaacgctatgtggagtcgcagcatcaccgtggccgcccctacataggcgagtatctggatgaagtgaccggttattggttgaaaggagatcaggaacgcagccgttattacaatcattctacttttaatgatttgatgattaccggtttgatagggctccgtccgcgcatggataacacagtggaggtgaatccgttgattcccgaaggaaagtgggattatttctgtttggataatgtgttgtatcatggccgtaacctcactattttgtgggataaggacggcagccgttaccagcgtggaaaaggtctgcatatctatgtggatggaaaggaagtgggacacgccgatacattgacccgtgtcctttgtgagaatgtgctataaatttgaataaaggggatgtcttaagataataaacagactgttgaaagaaaaatgaattacagaaaattcttaatagccgctttgttagttatgtctttcgccgtgcaggcgaaagacataactgttacccgcctgacgtgtgagatgcgcgacggaagagtgaccacctctgatacccctcgtttgggatggcagatgagttcgccggaaaatggcacgcggcagaccgcttatgagatagagattcgggatgtatgggcaggaaaagtagtctggaacagcggcaaagtaaaatccgctcaaagccagttggtttcctgtgcggatgcggtcttggagaaggacaggcattatacttggcgtgtccgtgtctgggatgaggctgatacgccttcggcatggagtgccccctctgatttcagtatcctgacttccgaagcggctttcgccggcagtgaatggattggggccattacccgtaaggatgcccgcatacccgaaggtcggaaatatcatggcagtgaactgaaaaagcctgaggcaaaggccgcctgggatgctgtggatactttggcaaagaaaagtatttatctgcgccgtgagttccatgtggcaaagaaagtgaaagacgccacggcgtatgtatgtggcttgggcttttatgaattttcgctgaatggagaaaaagtgggagacagcgaatttgcccctctttggagcgactatgacaaaagtgtctattataatacttatgatgtcacctcgcaagtgaagaaaggcggtaacgccatcggagtcctgctgggaaatggattttacaatgtgcaaggcggccgctatcgtaaactgcaaatcagtttcggcgctcccacgcttcgttttcggatggtggtgaattatgaagacggaaccagtgaaacgattgtttccggaaaggactggaagtacgatttcagtcccgtactgttcaattgcatctatggcggagaagattatgacgcccgccgtgagcagaaaggctggaacatgttcggttttaaagagcaggattggcatcctgtcgtgattcaggaagcccccaaaggggtgcttcgtccgcagatagcgcaaccggtaaagatcatggagcgttatgatatccggaaagtgaccaagctcaccgctgaacagataacagccgcctgcaagtcaaccaaacggacggtggacccgtctgcctttgtgctggatatgggacagaacctggccgggttccccgaaattaccgtccgtggaaagaaagggcagaaaataaccttgcttgtatccgaatccctgacggacgagggagcttgcaatcagcgtcagaccggcagacaacattattatgaatatactttgaaaggggagggagtggaaacttggcatcctcgtttctcctactatggcttccggtatattcaggtggaaggtgctgtgctgaaagggcagaagaatcccttccgtcttccggtgatccagaagatacagtcgtgctttgtttataactcggctcctaaaatatccaccttcgaatgctccaaccgcatcttcaatgatgcccaccggctgatagagaaagcggtgcgaagcaacatgcagtctgtgtttacggattgtccgcaccgggagaaactgggctggctggaacaggatcatttatgcggtcccggtttgctgtacaattatgatttgacgggctttgttcctcagactcttcagaacatagccgatgcacagcatgccaacggcgcggttcctaccactgctccggaatatgtggtgttcgagggccccggtatggatgcttttgccgaatctcccgaatggggatgtacctttgtggtattacctttcatgtattatgagacgtatggggatgattcattgattagaaaatactataacggaatgcgccgttacattgattatatgactacccgtgccaatgatggaatcgtttctttcggactgggtgattggtatgattatggagatttccgggccggattttctcgtaatacgcctgttcctttggtagctaccgcccattattatatggttgttcgctatctggtggaggcggcacgtatgctggataataggtatgatgtagcatattacactcatttgggtgaagaaattaataaagcattccatcgggagttttatcacaaggacactcgtcagtatggtacgggaagccagtgcagcaatgccttgcctttgttcctgggaatggttcccgccgatgacagacaggcggtgcttgataatctggtagcggatataaaacgccacggcaaccggctgaccaccggtgatgtgggtaaccgttatctgttccagactttggcgcgtaacgggttgaatgagctgatgtacaccatgcacaaccatgaagaagcacccggctatggtttccagctgaaattcggagctaccacgctgaccgagcaatgggacccgcggcaaggttcttcgtggaatcactttatgatggggcagattgatgaatggttcttcaactcgctggcgggtatccgcaccgttgagggaaaaccgggaatgaaggaaatagaaatacgtccccgtccggtaggcgatttgacatacgtccgtgcctctacccaaaccttgtacggaaaagttgcggtagactggacccgcgagaatggagtctttacattgaaagtaacgatacctgtagggtgtacggcacgcgtattccttcccgatgaaaaagagccgaagatagtggaaagcggaacttattcttttaagaaataaacgcggttttcatagaaaaagccccctaagggtatttggtaaaactaaaatcaactaatgaacaatatgaataaacgtacctttttaagtctgttactatgtgtttgctgtctgtcttttctgcatgcggagcgtgtggatatgcagcaggcaggtgccgatgtgcaaggcaggaagctgaacacagcattgattaattccaccatcgaccgcctgaacgcccatggtggaggaaccctctttttccccgcaggaacttatctcaccggttccatccacatgaaaagtaacatcactctggaactggaagcaggagccaccttgaaattctcggagaactttgacgatttcctcccttatgtggaagtgcgtcatgagggaatcatgatgaaaagtttccaaccgctgatttatgccgtggatgcagagaacatcaccatcaagggtgaagggacactggacggacagggcaaagcatggtggacggaatttttccgcgtccttgtagatctccgggacaacggcaagagaaacatcaacaagtaccagcccatgttcgagaaggaaaacgacctgaaagccctttacgccgaaaccaacgaagactggcacggcacattggaccgtcgtttcttccgtccccctttcatacatcccatccgttgcaagaatgtacgggtagagggcgtgaagattatcaactctcccttttggaccgtaaatcctgagttttgcgataatgtgaccattaagggcattaccatccacaatgtgccttcccccaatacggacggcatcaaccctgagtcttgtaagaacgtacacatcagcgactgccacatttcggtaggcgacgactgcatcaccatcaaatccggacgtgacctgcaagcacgtaaactgggcgttccttgcgagaatatcacgattaccaattgcaccatgttgagcggacacggtggtgtagttatcggcagcgagatgagtgggggagtgaagaaagtgaccatcagcaattgtgtctttgacggaaccgaccgggggattcgtctgaaatccacccgtggtcgcggaggcattgtagaagatatccgtgtaagcaatattgtgatgagtaacatcaagaaagaggctatcgtcctcaatctgaaatatagcaagatgcctgccgaaccgaagagtgaccgtactccggaatttcgtaatatctatgtgtcgggtgtgacggtccgtgatgtgaatacccccattatggtggtaggccttcccgaagcgcctattaccggtattgtgatgcgtgatgtgtatattcagaatgccaagcaacgctgtgtttttgaagactgcaaggacttggtgctggatgatgtgtatgtggatggtaaagaaataaaatagacttcccgatgaagaaacaactattatggtgcatggcggcactctctttttccgctgcatctgcacaaacttatgaaacccggttcgcacgtccgttatccgatgtgttgaatgacgttgccgcccgtttccaggtccgcttgaaatatgacgtggatacggtggggcgtgtgcttccgtatgccgatttccgtatccggccttattcattggaggaaacgctgaccaatgtgctttcccccttcgattataaattcgtaaagcaaagtgacaaggtatataagttgaaaccttacgaatacgcccgccgcacggatgccgacggagaaaaaatgctggcataccttagtggtttatatagtgataaaagtcaatgggaacagcgcagggagattctccgcaaagaggtgcgccaacgtctgggactggatgatatgctggggaaaacagtgaaggatgcaaagcctgttctttccaaaatacgcaaatttgatggctataccgtgcagaactttgcattggaaaccttgccgggactttatgtctgcggttcagtctatgccccccgcaccaaaggcaaacatgcactgattatctgccccaatggtcattttggacagggacgctaccgcaaagaccagcagcagcgcatggcgactctggcacgtatgggggctgtctgtgtggattatgacctgtatggttggggtgaatccgccttgcaggtaggaggaaaggcgcaccatactgccgatgcgcacaccattcaggctatgaacggaatatggatactggactatatgctggcaaaccgtaaagatatagatcctgcatgcatcggcgtgaacggtggttccggcggaggaacgcagacggtgttgcttaccgtcctggacgaccgttttacagctgccgcccctgtggtcagtctggcctctcattttgatggcggttgcccgtgtgaaagtggcaagcccatccagttggcaggtggaggaacttgcaatgcggagctggccgccctgtttgccccgcgtcccatgctggtggtttccgacggaggagactggacagccacggttccccgtttggaatatccttacttgcaacgcatctacggtttttacggtgcgacggacaaggtgagcaatgtacatttgccgcaagaacgccatgatttcggtccgaacaagcgcaatgcggtttatgatttctttatagacgtgttcggccttgaccggaacatgctggatgaaagtaaagtaaccattgagccggaaaacgcattgaagagctttggtgagaaaggtgagaaactgcctgccggagccttgagatataaagaatgattttgtcgtttatttattaggttaagagttagtgtagaatctccctcttgcatagcctgtgaaggtgagcaagggggaactttttttagatatgggggattaatactttttgtcgggtatatcaggccttgtcatgcggactgttaagtctttttgtacggactgttactatagtcttcggcagtggaccgtacagtctgctacagtggactgtacggtctgccgtagtgaaacatacggactactgtcgtagtctgtaaaaggtaaccgtaagaaatgctttaatggtactgaaaaaaagacttaatggagctgaagcgatgaattaactctgcatttatgttataatcatctttaattctccatccttgtggcgctttcggtcgttttcttgtttatagttgcggattcaaaccggtttctacatcggatttcagccgggtataatggaaaaagcggaggttataataagataatgcgtttctgtaatatggcagcaatctgttgtctcagttgcggggcgctgatgggcttggccatatagccgtcgaagccgttttccatggcccgttgttcatcactggcataggcgaaagcggtaacagcaatgataggtacatccaaggatagttttcgtatttcccgggtggcctcatagccatccatcaccggcatattgatatccatcagaattatctgaggggtatggagcttatacaaattgaccgcctcttttccatcccaggcatgtaccaggttatattctcgtttcaagatagattggaacagccggtaattgctctcattgtcttcggcgatcagaatggtcagcttgtctttttgcacggaaatgagttgatgctcttcctctttcttgttctctgcagcggcaggctggtatggaatggtgaaccagaaagtggatccttttccttcctcggactcaacaccgatgcgtcctcccatgtgctctacaattgtctggcaaatggatagccccagtcctgtaccctgtacaaaagagttcagtttgacgaaacgtccgaatatggagttcactttgtcggctggaatgccgcaaccggtatctttaacatagaaataaagttctttgtcgcatagtttgtagccgaaggtgatgcttccttgtgaggtaaatttgctggcgttgttcagtaaattgttcagtacctgcatcagacggttcttttccgttcttatgaggcaggagggaagtcctttctgtacaatcagttgaatgccgttgctctctgtccgataacgggtaacactttctatctcggagataatatcattcagttccacgttggaataacagaattccagtgtgccggcctctattttcgataagtccagtatgtcgctgattaattgcagcagcaacgtattgttactttcaatgatattgatatattcctgcttttcctgttcctcttctgcagcagcaaggatgtttgagaaaccgatgatagcatttagcggagtgcgtatttcgtggctcatattggcaagaaaagcggacttcagccggttggattcttccgcgcggtccttggctgaaagcagttcgtcttccattttcttccgttcagttatgactagggaagatcctaccaaagtgagcggcattccgttttcgtctttgctttccacagctgcctgcgcctctatccagtctattttccattgtgttccgtcattggccagcacgcggtattcctcttttactttctctattttcccgtctgccaggtcacggtaagcctgtatcacgcgcgggcggtcttctttaatgattttagcgaagtattgctcatccgaaacgctcaactgatcttcgctgatgcttcccggcatggccgccatggcaatggggcggttgagatcgcataaaatggtatggtctttcaaattccatttccaaggtacgatgttggctacttccagtgccatggaaagtttatggttcgtggcgctcagcatttgctgcgcattgtgcagttcggtgctgtccatgcagaacacatccactgtgtccggttcggtagagcaattcaggacaacatcatagaaggtgttgacggtcttaaaataatatgggaaggtgatcgatttcttttcttttaaggtgatactcatgaaatgggtgaattccggcaaggactccgggaaaatttcagaggctcttttccctattatatcggatttgggcaagaaacatcgttcgaaataacggttgacatcccgatagatgctgtctataatatttccttctttatcccatattacctgttccttcatgtaaaggataggcatattgtctatcagattggtatattgtgtgttcgtgtctatttcattttgctgggcgcgtctcagcgctttcagcatttgaatgcgtttttgctgtgtcacggccatcagtataaaagcaatgagtacacttaggatgatccatttatatttgttcagaaagttggccggtttgtcatagaagacggtgtcaccagggcataggtcgggatcgagtcctttatttaccagtcttgtgtagttgaatgcggggtgtgcttcgttgggttcataaaaaggtatgtcgctggctttcttcccatgtagtatctcgtctatcgttttcagtaattgcctggtaaagatttggtcattatacatgtatcctcctaccatgccgccgtcatccatacctgcatagcggatggtgaacaaaggggcggagatgctggcgatacttctgtaggcattaatcagaaaattgcttgaagtgaacgattcggtgaaccaggtggataccagaatgcctgtggtcttgtctgttttacgtacggcattatatagctgatgcagactgttggtacgcgaggagatgtattcgtaatccatttgcgggtatttgtctttaatcagctctcgcagttgcttgtcatattccggattggggtagatgccgtctcccaggaaaatcagtttcttcataccgggaatcatcctgcacatcagttgcacgttttcttccagatagatgggggtgtgcatgtaggtgaaattgaactcttctgccaattcgctcatgtgtgtcttttcttcgggggtgactgtatctctctgcctgtagaatttctcatggtacacataggggtcggctccgcatacaatggcaggtactttaccccataaagattgaatctcttctctgaaaatcaggctcatgctcccgatgaataccagcaggcggggaggggtggaaccatatttcgaggaaagaatttctgggaatctctcgattttagtggagtcgcctaccataaaaagattcagatgctctatgtaagcgtccatgttctctattccagctattttatgaacaatgggggtggtgatgctgttgctccagggagaggattcgttgtagctgttcagaatcagaatatagttccccgtctcggtgttttcctgtacatgggaggctttgccgatggttgcaaagagggtgaatatacaggtacatatcagtaaccgttgtatatgggctacacacgttcttttaagatttctgttcattattgatgtcctactcttcttttattatatagctacgatgcttgtgatgcaacaaatgtactattaaattaatgagtggacgaagaaatggaaatgtttaacaaatattaaaagagacaggacgggatggaaagttttcgtataggcaaatgggagatgattggatgggaattcctgccggccgatatggcagtggggcgcgaatgctgataaagggagtgggaggggaagtcattcttttgttctatttcttttttatataaaggaatagtcttatatttatcccgtcatcttatttttgaaaaagtaggggaacatcacttaatcagaagtagttatggaatatcacttacgtactaaattgaatggaaatatagcaatgacttcctgtttccatgaaaactcctttttgcagcgtgacaggagtctttataaatttatatgggtgcggcatggaacgttggatgtggaagtggatcatgtggtgatgcatctggaaaaagaggaaatgatttcgcttactcctttgcatcatgtgcagataaggggagtgggcggtgaatacctcacttttttattcaatagtaacttttattgtatttacgggcatgacagcgaggtgtcttgtaacggattcctgtttaacggttcttcccgtgtcatgcgtttgaagctttcgccttcccagtcggcccgtcttgacagtattgtcgatattttcaggggggagtgtggaatacaagacaacttgcaggaagaaatgttgcgtattattctgaaacgtttcattatcacttgtacccgcatagcccgtgaaaagtttgatgtggacccgggacgtgagaacatgtttgatgtgattcgtcagttttatgtactggttgacagtcattttaaggagaagaagcaagtacaggattatgctgatatgttgtgccgttctcccaagactatttctaatctcttttccctttacggactttcttctcctttgcgtgtcattcatgaacgcgtggatgcggaagccaagcgcttgttgctttatacgggtaagagtgcgaaagaaatcagtgagattctgggatttgaggatttggctacgttcagccgtttctttaagaaaatgaacaaggagagcctttcggaataccggaaaagagagaagcgggaataattgccaacctatatggggaaattgccatttaccggagggggaaaaccaccgacctttgcaccaggaagttaaatcttttaataatgaaagcaatgatggcaaaattaaaatctctgtttgttgcgtttttaacaatagcagcatctgcccaaaaactgggtatcaatcttatccgtgtggcaatccttgtaatttttgtatggattggtggtctgaaattctggaactatgaagccgaaggaattgtgccttttgtggcgaacagtccctttatgagtttcttttataccaaggacgctcctgaatataaagaatataagctgaaagaaggcgaactcgatgaaacgaagcacctgtggcatgaagagaacaatacttatgggttctctcatggattgggtattttgattatggggatcggtatcttgacgtttttaggcatcttttctccgaaaaccggtttggtgggggccggactggctattgtcatgacattgggcactttgtctttccttgtaacaacgcccgaggtgtgggtccccgatttgggaagtggcgaacagggattccctttgctgacgggcgccggtcgtctggtcattaaggatattgctattctggcaggagctgttgtcgttctttcggatagtgcgggaagggtattgaaccagttgaaaaagtaaagttggaaagaccggtcacggacatgcccttttatagggggtgtatatggatgcattccggcgagaggcaagtatttcctgcaagacataactatctatgaggcaagttgcatcctgtgtcatcttgctgtctgtcagctattgataatgaatgcaaatttggcagattctgcggttaacccctgttaagtgcttatctgtctgtgttaaaagaggaaaaaaaactctgacaaacggtacaaccgtacaatatttgtcattacattagcgtcataaatgttaaaccaaacttgaaattaacaaattaatagatattaagttatgaaacaagcaactaaaatggtactaggcgcagcagcaattgtagcagtcagcgcaggtgtagcaggagtaacggcttattctatgttgaaacccgagccaaacaaaagcgtggcttttaatgatgtgttccaacaaaatccgaatacaagactcgccgcgttggacgccactcaaatgcaaccggtggatttgactcaggcagcggaaaattcagtgcatgcagtagttcatataaagtcaactcaagaatcaaagactcagacggttaccgttcgtgatccgttctatgatttctttggtgatatttttggaaatggcagaggcggcggtcagcagcgtcaggtgcagactcctgaaagagtgggattcggttccggagtgatcatctcgaaagatggatatattgtaacgaataaccatgtaatcgataatgctgatgtgatcagtgtcaaactgaatgacggacgtgaatacaagggacgtgtaatcggcacagaccccagcacggatttagcgttggttaaaattgaagcggatgagcttcctacgattcccgtgggcaattcggaggctttgaaagtaggtgagtgggtattggctgtgggtaatccctttaatatgacttctacggtaacagccggtattgtgagtgccaaagcccgttctttaggggtatataataatggtgtggaatctttcatccagacagatgctgcgatcaaccaaggcaacagtggtggtgcattggtgaatgcaaggggtgaactggtaggtatcaattccgtactttattcacctacaggagcttattcgggttatgggtttgctattccaaccagtatcatgacgaaagttatagccgacttgaaagaatatggaaccgttcagcgtgcggtattgggcatcaagggtactccgattaatgatgaccagcagatgatgccggaagaaatcaagaagaaggtgaaggaactgggcgccaccgacggtgtgttgattgctgagataattgagggaggttctgcggccggcaacttggaagtagatgatgtcattatcggtattgacggaaaacgtgtgaagaactttgcagagttgcaggaggggttggctaaacaccgtccgggtgacaaagtaaccgtcaaggtgttgcgtgacaagaaagaaaaggatatcgagatgaccttgaagaatgcacagggaacaacgaaagtggtgaagagtgcgggcatggatatcttgggcgcagcattccgtgaagttcctcaggaattgaagagacaattgaatttgggatatggtgtggaagtcacaggtgtgacagacggtaagatgaaggctgccggtatccgtaaaggcttcatcatcctgaaggcaaacggacaacctgtcaaatcagtaaatgatttggaagatgtgctgaaagctgctacccagtcaccggatcaggtattgttcctgagtggtatgttcccatcaggtaaacgtgcgaactatgcagtggatttgacacaggaataagaagatttttaaggtagaaagtttcaataggtaaagtttagaggatgcacggtaagggttacttccgtgcatcctgattttatagtcaaacaggactgataaccttattttcgcaaaatatttaggaaaagaaggacaaagatagtcttttttgatttattagctaatatttttcaaacaaaaatggatgtattccatttaatgttgtaaatttgcatcccaaatttgttttatagagaatgagacaattaaagattaccaaaagtatcactaaccgagagagcgcatctctggataagtatttacaggaaataggccgtgaagacctgattactgtagaggaagaggtagagctcgctcagcgtatccgtaaaggcgaccgggtagcattggaaaaactgacacgtgccaacttgcgtttcgtcgtgtctgtagccaagcagtatcaaaatcaggggttaagtcttcctgacttgattaatgaaggcaacctgggattgattaaagcagccgaaaagttcgatgaaacccgaggcttcaagtttatcagttacgccgtatggtggattcgtcagtctattctccaggcattggcagaacagtcacgtattgtccgtttgccgttgaatcaggtaggctcgttgaacaagatcagcaaagccttctctaaattcgaacaggaaaacgaacgtcgtccttctccggaagaactggccgatgaactggaaatacctgtagacaaaatctcggacacgttgaaggtttcaggacgccacatttctgtagacgctccttttgtggaaggagaagacaacagcttgctggatgtgcttgtgaatgacgactcgcctatggcagaccgttccttggttaatgagtcacttgcgagggaaattgatagagcactctctacgctgaccgaaagggagaaggatattatccagatgtttttcggtattaatacgcaggaaatgacgttggaagaaatcggcgataaattcggcctcactcgtgagcgcgtacgccagattaaagagaaagccattagaagattgagacaaaattcgcgtagcaagctgcttaagtcttatttagggtaagaaagattcggtttccgaaaagaaaacaaagcacaagatggaaggttgcttccgtcttgtgcttttgttcataatataccaataatgcctatcggctgcactatgtgccgcatggtaatgggcacatcagcaaattattatagttaattaatctattactttttcgtatttgtccgtaaataactacttttgtcctctaataaaattataaaattagaattatgaaatccataaagattctgtgctctttattattggtactgacggtatgctcggcattctcattgaaaggaagtaaatctgtttatatagtaggcgtatccgcatcgtttacagattcattggtttatttcacggaaatccagttgctggacagtgtgagtctggataagaataagatgttgccggaacgctcacaatacagttatcagctgaaaaattatctggaaaacgaggaagggctgacgaaccgtacttgctttgtttatttctcgaacagcagaaagaaactgcagaagaccatcaacaagatgaagaccaagtatcaaaaaggaaagaccttgctgattcgcgaagtgaaccccaatgcgttcaagttcaagaaaccggaagagtaatccttttcttatgaaaaagattctatttctattcttggcagcctgctttttcttctcttgtgagaaggaaacaatcgtgattcctcagcaacatgccggaagaacggttctggcattcttttgggcggataacagtttgaattccagtttgcgtaataatattcagacgatgatgcaaggacttcaggctatgaaggattcggctgctttattggtatattgggatggtgaggcttcggatatcagttggccggagccttgtatcgtagaatatgtaaccaatggtcaggggggtatcaacagcctgtctaaaggaacgatagatgcaatgatggctgataagaatacatctatctatgatttgattggtattggtaacatcagaaaaaaatatccccctcagacatcgacggagaaaaccgtcatgcagacagtgataggtgatatgatgagtgcttacccgtcggaaagttatggaataatctttggatctcacggttcgggatggttgcccactattaccggcacccgttctataggacaagatggcgggcggtattccagtgacacagcgttgataccggaattggcggaagtgttgcgtacggtaaatcctcaaaagtttgattttgtcttgtttgatgcgtgtatgatggggtgtgccgaggtgtattatgagctgaaggatgctgccagatactgtatcgcttctgtacttgatataccggcagccggatttccttatgcaagtgtgatgccttatttgtatgaaaatgcgatcaaggattatttggggccaatctgtaaagattatatagattattataactataatggttggggaaccatttcggcagtggattgcaatcagatggaaggcctggcggaagcggtcagaagtgtgattttgtccaatcaggatagcctgaagaacgtggatacagctgatttgcagcaatatggcaaaggcagcagcaacttcaaaggatatgcctatgatatgttacagtttattgaaaaattgtgtggaggaatggctccggacgattttacgcaacaattaaagaagacggtcgtttatacaggttatactcatgatcccacctcatccttgtacagaatagatggggataactacagtggaatgggtatgtatatccccaattcattcaccactcccaaatatttgctttggaacaattatttcaagtcttccatagcgtggtatcatgcatccggatgggctgaaacggaatctatttgggggaattgaaggagaatgcagccagttgccttttacttgatcccgaataatagatatagcggatggaagtaccgaatttccggtattcctccatttccaccgagttgtctactgcatcctgcagggcttgtttaaaggcggcataatgggtgttcatataagtggcgttgtccagttctcctgtaacactgtagaaatagctcacactattatctttctcattataacaggtgctgtccagtgtaatcgtttcgttcatgcgtgtggggcaggaccggttggtcttttcggctgtctgtttgaatttacggacttgtgaacggtggttattattacatcctgccaaagtaaggatgcctagggccgctattataactgtttctcttttcattataaatcggtattttgaagcgaaagtaaactataagtttgaacaaagcaaatggatttttgttttttattagtaagtttgtgcaaacaaaaaaagtaaaacatgtctcgcattatagatgaattaaaacgtacagaccacaagcgttatctgggtggtcttgatttctttaaatatattggtcccggattactggttactgtaggttttattgatccgggaaactgggcctcgaattttgcggccggttccgaatttggttacgcgttgttgtgggtggtgaccttgtctaccattatgttgattgtgttgcagcacaatgtggcccacctgggcattgtgacgggattgtgcctgagtgaagcagccacgcagtattgtcccaagtggatatcccgtcccattttgggcagcgcggtgctggcctccatatccacttcgctggcggagatactgggaggagccattgccttgcagatgcttttggaaattcccattgcctggggatctgtccttactacgatgtttgtcgtcattatgcttttttccaattcatataaaaagatagaaagagccatcattgcttttgtatccgtaatcggcctttcgtttctgtatgagttgtttttggtagatattgactggcctgtggcgatccgttcctgggtggttcctgagataccccagggcagtatgctgattatcatgagcgtacttggggcagtggttatgccgcataaccttttcttgcattcagaggtgatacagagccacgagtacaacaagcaggacgagagctccattcgtaaagtattgaaatatgaattctatgatactttgttctccatgattgtaggatgggccatcaatagtgccatgatcttactggcagccgctactttcttccgtacccggactccggtggaagagttgcagcaggcgaagtcgttgcttgacccgttgctgggcagccatgccggaatcatctttgccctggcattgctgatggcggggatttcctccaccataaccagtggtatggcggcaggttctatctttgcgggtattttcggtgagtcttatcatatcaaggatatccactctaaggtcggtattttgatttctttggggatagcattggttcttatcttctttattgagaatcccttttacggacttatcatttctcagatgattctgagtatccagctgcctttcacggtgttcctgcaagtaggactgacctcttccaaacgggtgatgggcaaatatgccaactcccggtggagttcattcgtgctttataccattgcggtgattgtctccgcattgaatatcatgctgttgctcagttgaataatgtgcgaatttgcccatgtgccaattgccatgcgggaccatagcgcagcacgtgggcacatgggcaaattttttatttcgttttgctttccgagataatcagcagcttgtcaccggcgtgcagttgcagagagccattgggaatcatgaactcgtttcctctttttatcagcatcaccagcatacctttaggtaggttcatatccattagtctgtttccttttgccagcatttcttccgtcagtacgatatcgcggaggtctgtattgatttcctccggtatctctactccgaaatcatttcctgttttttccagtggggtatccagatggagtaatttggccatccatgaaatggtcgttccctgaaccactaaagacaatatggtaatgaagaatacgatattgaaaatctgagtagatcccggcacatcagctactactggataagtggcgaatatgataggtactgctccgcgcaatcccacccaggaaataaacagccgtgagttgatgttcatctttttaaagggaaggaggcagagcaggacactgagcgggcgggcgaggacaatcatgaaaatgccgatcaaggttgccggtatggcgatggacaacatttcatggggattcaccagcaatcccaggctcaggaacatgataatttggaagagccaggtcatgccgctcataaaagtagcgatctccttacggtttacaatgcgtgcgttacccaccatcatccctgctatatagacagccagatagccgtttcctttacacaggtcggtcatggtgaatgtgaagaaaataaagctcagcagcaagataggatagagtgactggttcttcaagtcaatcttgttgatgattgctaccgccagttttcccagcaggaatcctgatgtgccacccacagcaaactgaatcaggaatgaaatcagaatatcgtctgcccccatgcctgccgacgtgatgaactgtatcaggacgatagtaagcatatacgccatagggtcattacttccgctttccagttccagcatcggtcggaggttatgtttcagattcatgctttgcgagcgcaggatgttgaacacggaagcagagtccgtagaggacatggtagccgccagcagcatggccgtcatcagggacatggtaatgctgacattcgagaatccggaaatccaataaataaagaatccggtgaaaatagtagtaagcaacacaccgaaggtggaaagcagtatgccttgtggcaatacaggcttgatatccgagtatttggtatccataccccctgagaacagaatgatgctaagggccatcatgccgatgaactgggcttcgcccgcatcatggaactggagtcccagaccatcgcttccgaacagcatgccgaccaataaaaaaacaagtaacgtagggattccgaaccggtatccggtcttactcactacaatacttacgaacaataggatggaacctatcaagagaatgttttctgcattaaatatcatacttctgtgatcttgtttaattttttaatatgatgtgccagcatcaggcaggctgtgataaacgctaacagatcggatacaggcatactgagccagataccgttcagtccccaccaatgaggtagtaacagcaggcagggtaataaatacaacagttggcgggacaaggagaggaagatagaaattttcgctttcccgatagattggaagaaactggaaattacaatttgtattcccacgaaaggaaacatcagtactccgatttgtaacccggtgcgtgccaatgctgtaagttctttatcgtctgtaaacatattaacaaccaaattagggaaaagttcgctgaaagcaaatcccaacgaagtgatgcacccccctgcaatcatgcaatatttcaaagtctgcttcacccggccgaatttgtgtgcgccatgattatagcccacaatcggttgcattcccatagtcagccccatgataaccattacaaacagcatcagcagacggtttaatatgccgtatgcgccgatagccagatcgcccccgtagagcagcaggctcttgttgaatataatgacaatggccgaagcgcagacattcatcaggaacggcgacataccgatactgaagatattctctacgatccgtttccttaatttgaatatccctttcttgaagcggatataacttttttcctgcatgaaatggctcagcacccatatcatgccggcaaactgtgaaaggatggttgccgtggctgctccgcggattccccaaccgagccagaaaataaagacaggagccagaataatgttgcatcccactgtcagcatggaggacagcatcgcctttcggggataaccggtggcacgcatgatattattcagtccgatcattacataggtgacaggacttcctattaatataatctgcataaagtcgcgggcgtatggcaacgtgtcatggcttgccccgaagaagaacagaatccggtccagaaacagcagggtgatgcctccgtagaaaatagaatttatcacacagagcaccgttacgtttcccagcaccttctcggcaccgtccgtatccttctgccccaggcggatagaagaaatggtagcgccacccaccccgaccagtgtacagaatgccaccagcagattcatcagcggaaaagaaatagccaagcccgatatggccatggcgccgacaccatgaccgataaatacactatcaataatgttgtacagtgatgtcagtgtcatccctatgatggcagggatagagtactctaaaagcagctttccgaccttttctgtacccagtatgtgcgggttgttttctttcattcgcgtttttgttatttttaagctttgcaaagttaggaatatggaggattattcggacctttgtggcgttaaatcaaactaaaagtaatatgaattcaacaaaaagcatagcagctttattcgattttgacggagtggtaatggacacagagactcagtatagtatattctggaatgaacaaggacggaaataccatccggagcttcccgaattcggccggttgataaaaggacagaccttgacacagatttatgccaactattttgccggaatggaagaggtgcagcatgaaattacagaagatttgaacaaatttgaaaaaaatatgttatataattatatcccgggcgtagaggctttcctgaaagaattgagggaaaacggggtaaagatagctatagtcacaagttcaaatgagatgaagatgagcaacgtatataaagcacatccggaattgaagcaaagtgtggaccgtatcctcactgctgaaatgtttactcattccaagcctgaccccgaatgctttctgttaggtgcgacagtttttgacaccgtgccggagaactgtgtggttttcgaggactcgtttcatggacttgaggcggggaaccgtgccggaatgactgtgataggactggctaccaccaattctgaagagcaaatacgcgacaaggcaaatgctgttattcaggactttaatggattcagtttcgaaaaaatgaagaatatgatgaggtaatgtcaactaaaacatctacctttgcagccgttttttataaattaaagtaaatatggcaggatatatttcgggcgatacacgcaaagtaactacccaccgtttggtggaaatgaagcagagaggcgagaaaatttctatgcttacctcctatgattacacgacagcgcagattgtagatggcgcaggcatcgatgttatattggtaggtgactccgcttcgaatgtcatggcaggaaatgtgaccacacttcctatcacccttgatcagatgatttatcatggaaagtctgtggtccgtggggtgaaacgcgcgcttgttgtggtggatctgccttttggcacttaccagacttccgaatacgaagcggtgaccaatgcgatcaaagtaatgaagattacgcacgctgatgctttgaaactggaagggggtgtggagatcattgatgcggtaaagaaaatcattgctgccggcattcccatcatgggacatttggggttaatgccgcaatctatcaataaatatggaacctatactgtacgcgccaaggacgaggaagaggccgagaagttgttgagcgatgcacatttgctggaagaggcagggtgttttgcgctggtacttgagaaaatccctgcgtcactggcagagcgtgtggccagggaactgaccattcccgttatcggtatcggagccggtggcgcggtagacgggcaggtgctggtcgtatcggacatgctggggatgaccaacggtttcagtcctcgtttcctccgtcgttatgccgatctgcatacagttatgacgggagccatacagcagtatgtggatgatgtgaaaaaaggggatttccctaacgaagacgaacaatattaaaagtttttgctgatatgtatgatgacttcttctttccgtatgaaaaggcaaaactgtggactgggaatatgtttttgttatccctttccaattttttgctttatgcatcactatacatgatgcttcctgtgctgcctttatggatggtgcggcactggtattgcagttatgcggaagcaggagcagccattgctgttttcgggctggccatgttccttccgggaacattcaacagctaccttattgatacgttcaaacgtaaaagtgtgtgctttatagcgatattcctgtttgtggcatccagtctgctatatccgtacgttgcgaccgtagggttcgtagctttggtcagggctgtccagggagggctgttcagcgtcattaccatgactacgggcagtacactggtgattgatgtcactgcttcccgccgccgcacggatgccaatatcgcttttgcctgggcgggtcgttttggaatggtggtgggtcttgccttggggatctatatttatccttattggaattttcaccatatcatttataccagtatggctctaggagcgttggcgctggtgctgattccggcggtgaaagttcctttccgtgctccgctcagcacttcatggttctcgctggaccgttttttgctgccgcgcactttgtggccggggatgaatatgatgatggtggccattatctttgggatattggtggcacatatttacaatgaattgttttttgtttgtatcctgataggctttgtcctgtctttgctgcttttgcgttacgtgctttctcatgcttccggtcgttcggaggtagagctggggcaggcggcaatgataggaggattgttattgctcgctttttccaatagcttgatgaacagttatatagctggtattttgttggggatgggaaccggaaccactgtgtcacgtttctttataaaaatgatcagcctgccgaggcattgcgagcggggaacgggaaacaatacctatcagctgatgtgggaggcaggagtactgattggtttcctgtttgagaatatgtggactgagggtcatcccgataccatttattggatatgtatcggtatctgtgtcgttctgctgctgatgtatgagttcttcacacatccgtggtattacagaaagatggaggaaaaacagtgaaatatggcaacttacataaattaataatataaagaatatggcagacgacaaaaagattatcttttcgatggtgggcgtaagcaaagccttccaagcgaacaaacaggtattgaaggacatctacctatcctttttttacggtgctaagatcggtatcatcggtctgaacggttcgggtaaatcaacactgatgaaaatcattgccggactggagaaaagttatcagggagaagtggtgttctcgccgggctactctgtaggctatctggcacaggaaccgcatctggatgatgaaaagacagtgaaagaggtggtgatggaaggagtgcagagcatcgtggacacactggcggaatacgaagaaataaacaataagttcgggcttcccgaatactatgaggattctgaaaagatggatgcgctctttgcccgtcaggcagagttgcaggacatcattgacgctacggacgcatggaatctggacagcaagctggaacgcgccatggatgcgttgcgctgtccgcccgaagaccagccggtgaagaatctctcgggaggtgagcgccgccgtgtggcattgtgccgcctgctgttgcagaagccggatatcctgttgctggacgagcctaccaaccatttggatgcggaaagtatcgactggctggaacagcatttgcagcaatatgaaggtacggtgattgccgtaacccacgaccgttacttcctggaccatgtagccggatggattctggaactggaccgtggcgaaggaattccctggaaaggaaattactccagctggctggaacagaagaccaaacgcatggagatggaagagaaagtggcaagcaaacgccgcaagaccttggaacgcgagctggattgggtgcgcatggctcccaaagcccgtcaggcaaaaggaaaggcccgtctgaactcttacgacaaattgttgaatgaggatgtgaaagaaaaggaagagaaactggaaatcttcatcccgaacggtccccgtttgggaaacaaggtgatcgaggccaaaggagtggcgaaagcttatggtgacaagctgttgttcgataacctgaatttcatgctgccccctaacggcattgtcggtgtaatcggtcctaacggtgccggaaagactaccttgttccgcttgattatgggactggaaaccgtagacaaaggtactttcgaggtaggggagaccgtgaaactggcatacgtggaccagcaacataaagatatcgaccctgccaagtccgtttatcaggtgatcagcggtggaaacgaactgatccgtctgggaaacagggatatcaacgcgcgtgcctacctcagccgtttcaatttttcgggagccgatcaggagaaactttgtggaatgctttcgggtggtgagcgcaaccgcctgcatctggctatggcactgaaggaagaaggcaacgtgctgctgctggacgagcctaccaatgatattgacgtgaacacgctgcgcgcgttggaagaaggtctggacgattttgcgggctgtgcggtggtgatcagccacgaccgttggttcttggaccgtatctgtacccatatcctggctttcgaaggaaacagtgaggtctttttctttgaaggatcctattcggaatacgaagagaacaagatgaagcgtttgggtaatgaggagccgaaacgggtgcgctaccgcaagctgatggaagactgatgacgccctgtctataaaatcttacccaagtgtacgaacagtaacgtattcttgggtaagtttgcatatacacacaacggctcgtcagaaatgtatggcaacttcctcagtataaagacgtttttgaggttaagagcctttttattatacacctatcttattatgcgcgcaccgcatggaattcccgtcgggcccgtgtcccgggggcatccggcaggatgaatgtggttcactataaatataaattctctttctatagacctgccactgtaaattgtaaccgatttgtagtttgtatatcgtttctattagctatctttgcaacgtcttttaagacattaattataatattaattaataaaaagtttatggtaaaaagaatgcgatctttttttgcggtggttatgttggtaatcgctgctactgttaacgctcaggtcactacctcgtcaatgagtggaaaggtggtcgatcaaagcaatgaagccattatcggcgcgacgattcaggctattcatgagccgtccggcacccattatggggccattaccaatgtggacggccgttattccatccagggcatgcgtgccggcggcccttacaaagtagaagtttcttatgtaggttatcaatcagtggtttacaagagcatcaatctccagttgggagagaattacgtattggatgcgaacttgaaggagtctaccgaactgctggatgaagtagtgataaccgcttccaagagcagtaatatgaagtctgaccgcgccggagcggtgactaatgtcgatgcggccagaatgtcggaagtacctacggtgagccgcagcatgaatgatatcatgcgtctgacccctcagggagccaatatcggtagcggtttctcagtgggtggaggtaactaccgccagtcttatgtcactgtagacggagccgctttcaataatgccttcggtatcggctcgaacttgccggcaggcggttcgcctatctctctggatgcgttggaacagatttccgtttccaccactccctttgatgtccgtcagagcgggtttacaggaggtgccatcaacgccgtgacaaagagtggtacgaatgagttcaaaggtacagcctatatgtatacttccaatacccaccttaccggtaataaggtagaggactatgagctgacccgcaaccgtgaccacagtaccacctacggagcttctttgggaggtgcgatcattaaaaacaagttattcttcttcgtgaacggcgaatatcaggataatgtgcaggcaggtccgtcgggcatagcgcgtagcggcgccaatgacgaatggagcaccaacggcatcgtgcaccgtccgttcgagaacaccacaacggtaggcggccgtacctttgtggggatgaacaacatcagccaatacctgtcggaaaaatacaactataatccgggacgttatcaaggatactctttggaaactccttcttataagatcatggggcgtctggactggaacatcaacaacaacaacaagattaatttccgtttcacccatacccattccaagtattcttccaacccttcctcttccaccactccgtttaaggattcaatcatttatccgggcggagtagacggcagtgcgggtaagagcagttcgggacgtacagcgaatgccggtatgtattttgaaagctcacgctacatgcaagagcagaacttcacttccatagcttccgaatggaattcaaagtggggcgcaatcaataacgccttgcgttttacttattcttatcagaacgaacctcgtacttacgaaggtggaacatttcctacggtggatattcttgaccaaggctccctgtatgcctcatttggcccggacccctttacagaagggaacttgcgccaggtgaagacctttgtcattaccgatgaattcaatttctccagcggtatccataactttatgggcggtatccagtttgagtccaataaggcagtgaacggattcatgcaggcgggtagcggttattatgtctattcctcttgggatgattttgtgaacaacagagctccggctgctttcggtgtcacttattccaacaccggggacggttcccagttcctggcgaacatgaagtaccagcagctttctttctatctgcaggaccagatgaatatcacagacaacttcagactgactgccggggtgcgtttcgaactgcccatttatccggagctgaagaacaactataacaagaatttcgcacagattgactttgacggatatcattacgccacagaccagttgccttcatcctaccagctgaccgcctccccccgtatcggcttcaactgggaccttacaggcgagcgtaagtatgtattgcgcggcggtagcggttacttcatcggccgtctgccgttcgtatggctggtttcggcagtaggtaatgccaattgcggacaaagcacctattattataacgagcagaaggacgctaagtacggacaaccgagtttccacaccagcgtggctgatatgttgaaagatcctaacttgaaccttccggcggctaccgatcctgccgcaccttccggagccaccatcattgaccgcgacttgaagatgaatgccacttggaagtcatcattggcttttgatgcaaaacttcccggagacattgactttacgttggaaggtattttcagcaaagagttcaatccggctacagtgaccaatttgggacgtaagtttaaaggagagcaggagatagctccgggtgatgtccgcagaatgtttgagtactccaatgcgaacaagacggatgcttattatatcaccaatgcgggaaacagcgcttattattactcactcaccgcctcactggccaagacatttgatttcggcctgcatctttccgcttcctacacccgttcttatgccaagtcgtatggcgacggcatcggcgaccaggtgaactcggcttattacaacaaccgttactctgtcaacggaaataatgacacggagaccggctacggtacgtatgtatcgcccaaccgtgtgctggcttccgccgcttaccgtattaaatacgccaagaatttcgcttcctccttgtctttgatttatgagggtatgaacatgggctatgccggaggatattccgccgcccgttattcctatacattcaccggaaatattgtaggcgattacggctcaaacaacttgctgtacattccggcatcccgcgaggcgctggataagtggaactttgccgattatactgacagcaagacgggtgaggtgacttattctgccaaggagcagcgcgatgatttctgggcttacattaatgaggacagttatctgaaaggccgtaaaggcaagtatgccgaacgcggaggagccatcatgccttggcatcatcagctggatttgaagttcaatcaggatttcttcctcaatgtagggggcaagcgcaataccttgcagttcggagtggatatcaagaacttcctgaacttgctgaacagcgactggggaatttataagacggtgaacaatacttccttgttgagctataagggcggcgcttaccagttccagaagaacggaggaaagaaactgactgatacgtattccaatctgaacagtttcaattctacgtattccatacagttcagtgtccgttatatctttaactaaatgaaatagcctgtatcagacaatacaggaacaggatagagaggcgtacccatgaaggtgcgcctctttttgtatgcacattctttcgttttctttttgctctgtcattttgaaagtgagagagcctgaatgaaagtgacctgtcgttttgtcgtaggggcgggccggatttgtccggatcagtggatacggctttgggaataaggtatgctgaaaatagttccggcggtttccatttgcccttctttctacagtaatatgtggcagttgctctggaatttccggacagttttcccctcttttgaggcggctttttgttcttttcttaacataattgtcatattccgcctaaaaagtacccttttcgtttaaataatctaatataaattcaatttatatgaattaaatttttatctttgtctttcctattgggaatgaaatactaactaattaatttaaatcaaagacaaaattatgagaaatcatctaaagcatttcctcctgttggcagttctgacaatctgtttcactgctacggctgttgcgcaaggaacagtaaaaggtaaagtagtagatgccgagaacaatgagccattgattggtgccactgtatcggtcagcggtacgacactgggtactgtaacggatattgacggtaactttgtgttgaaacttacctcttctaaggctactcttgagtttaaatacttggggtatcaggacaaaacaatgaaggttactcaaaagggcaatgttgatttgggaactattgctttatcactggatgcaaagactttaggggatgttgtgataacttcttctattgctgtagcccgtaagactccggtggctgtaacaactttggctccggaatttatagaagaaaaattaggtacacaggaattccctgagatattaaaatcaactccgggtgtatatgctaccaagcaaggtggtgcatacggtgattcaaaaatcaacatgcgtggtttcaagagcgaaaatatcgctgttatggtaaacggtattccaatgaatgatatggaatggggaggcttgtactggagtaactgggcaggactgtcggatgtgacacgtagcatgcagactcagcgaggtttgggcgcttcgaaggtgtctgctccttcggtaggtggctctatcaatattgttacccgtaccattgatcagaaaaaaggtggttctatctcttatgcaatggggaatgacggctataacaagcttctgttccatgtttctacaggtatgtccaaagatggatgggcattgactttacttggtggaaagacttggggagacggatatatacaagggaccgaattctctgcttataattattttgtaaacatagccaaacgtatcaatgatgcacaccagatttcatttactgcattcggatcaccccaatggcataaccagcgcagtaataaagacggtttaagcatcaaaggatggcaggcagtgaaaaattatatgggtgacaagagtccgtatcgctataatcctacttatggattcggccctaacggtgagcgtatgtctgcttcgcacaatgaatatcacaagccgcagctttcattgaaccatcaatggcaaattaatgaaaaatcatcattgagcacagcggcatatgtttccattggccgcggatatggtaatgcgggacaaggatataagaaagatgccaatggtactacttatcgtaatatgtggtatggctcttataaaggaaacttgaatacttatttccgaaattcagacggtacatttgcttatgaccagatttatgatatgaatgaagccagtgataacggttctatgatggctatgtcaaaaagtatcaacgaacacaactggtatggcttgttgtctacatatacgacaaaatttggtgattacattgatttttacggaggtatagatttccgttattataaaggtacgcatactaatgaattgagtgatttgtatggcggcaaatatttcttggatgaaagccgagagaaggtgaaagcggtgaacaatgccttggcaggaactccggaatatgtgaagaaaaaattacaggtgggagatgtggtatatcgtgattatgatggctatgctatgtcagaaggagtatttgcacaagctgagtacaataaagataaattgagtgcgtttcttgcaggttcaatttccaataccggatattggagatatgaccgcttttattatgacaagcagcatgccgaatcggaaacggtgaattttataggctatacagtgaaaggtggtgccaactataatctgaacgaatatcataatgtatttgcaaatgtaggttacatcagtcgtgctcctttcttctcaggtggcgctttcttacagagtgcaactagtaatgctactaatccggatgctgtaaacgaaaagattttttcttttgaattaggctatggattccgttctccttatttcactgctaatctgaatgtatatcatacccagtggtttgacaagaccaatgccgcatctgtgaatattgaagatgagaaaggcaatcaggtggatcgtgccactatcaatatgcagggggtcgatgccactcaccaaggaattgaactggactttgtggcaagacctttcagatggttggatattaacggtatgttctctattggaaattggcgctggagcagcacgccgaaaggatatttttacaattcattgggacagcctttggcttatgaaaatggaaaatttgtagaggctactggtattatggctcctgaccatgcttctgttgcattggatttggatggtgtcagagtaggaggctccgcgcaaaccacagcctcactgggtgctacggcaaagatatcaaaggcattacgcgtaggtttcgattgtgtgttctatggacgtaattattctgactgggctattgaatcttctgatttgacatataatatcaacaagacgttggtgtatgattccccatggcgtattccttcagcgtatgtatgtgatttaaatgcaagttatagatttaagataggtggggtaaacgctattctttcaggagttgtgaacaatttgttcgatcaggaatatatttctgatgctacagatggttcaaatcatgactggcaaactgcttatggcatcttctatggattcggtcgtacatacaacttgaaattgaaacttaatttttaaactcaaagcctaaagaattttagaatatgaagaaaaatatatggatggtgctggcagccgcttcgttaatgactgcttgtgattataatgaaaaatattttgaaggttttgatgaaacagaccaaagtaatgtccagaaatatactgtagaatatacagagaaaactttcaaagaaacagaaagtgccaaggatgttattattccatggctcacccagaaatattatacctgtgacaatggttcgtttgcttctgtaagttatatgcaggaaaccactgaaatcaaagaagtgccggtattggagcaagattttgaacgtaatgtcgtagataaggaagctacggatgtggctggatggttgaattattctgtaaaaggaacagcaccttggtatgataaggcatatagtaataatgtttatacggaatgttccgcatataaggcagatggtgaagtacagtcatggattatctcaccgaaattcaaggcagaagtgggagatgtattctcttttgacgtctgtatcggaaattataagggggatgctttaaaggtgtatgtgtcctctacttttcaaggtaattcgggcagtattaccaataagtatacggaatgggaagatgtaacagataatttctctattcctcaggaaccggttaaaggctatggctctatggcgagggcaggaagtatgaaactggatgaatttgccggtaagaatatttatattgctttcgtttatgaaggggctcctgatggggtgactaccagtgtgcagattgacaatgtgctggtaatgagaaatgaatcggaaaccatcgtaaacaaagaagtggatgaatacgattataaagagaatgaatgggtatttaaacgtactgttccttctggattgttgtttgaaaccatcaccatgcagaaagaagattttcagcttgtggttgattatgtggcggcaaattttgatgaaggttatctggatactcagaaagtgggtcagggagaatattattatggcgcaagttctgcttatggcaactggaatgcaaaaggatatacgcgtaaaaagtattatgatgtaaccggagcaatggccaatttgactacggatgaagagatggatgcttattgtatagaacaggtaaaattgggacttgtgaagtttatcgaattagttcatccggaaccagtctttgtggacggacaggtgactaattataaagttatttcttcgatttatactagtacgggtaccgcttcttatgtggcaaagattgtttggagcgaagaggaaagtcgtttcgttctagaatcattggatgaggctgaataaattattttcttaataatgagcaaaagggagtttagctgtaaaagtatgaactcccttttctttttcttatttgaatgataaggtatgaaaaaaagtgaagtatgttttctcttccttttgtcccttttttgttttgcttgtagcgattctgcggataaggaagaaatggaatttccggaaaaggataatttgaaggtaacttttccttcggatttttctcctgaatgggctgcgtctgtagctggtaaagaagtaacaattgtcaatccgctttttgtcactcagacgtatagcggctcgaaacctcaaggaactattgttgtctcttccaaggtgaaacgtgcatttgcggatgtaaacctcccgtcggttgttgaatattccaaatgggtagaaaagcaggaggttgataaattgctgattacatcagagttccctttgattgacccgtgtaacacacttcgtataggaagtgagatggctggggttaaaggtaaagtgacttatagtacttccggttatcattttacattaacggaaaagccgtcagtttcttataatgctcggtctgtcgctcctactgtaaatgattataatttgaaagtgatgagtttcaatgcggaaaatttttatatgtatggtaatacgggaaatgcagaaaccttgcgtcagcatgctaaaatcttagctgcattgaaagaggcgaaagcggatatttatgctatttgtgaagtagaacagggagattttactgtggattatctttgtaggtctttgaacaatgcgttaggggaagaacggtatgcttggttgaatactcccggacaaaaatcatcaaaggtacaaacaaatgtttttatttatgataaagtgaaagttttgccttataaggagtttaaaagctataattttgataatctgaagatgcggtacatagttcaatgttttgaactgaaggatgataaagcgaaagtgattttagctatgaatcattttaaagctaaaactagtggtatagataagaatgacggtcagggaggttctgccgaccgtagggttatggaagcgcgtgagtgtttgaaagtatataatgagcttgttgcttattatgaagatacggatgtgctggttttgggtgatttgaacagctacggtatggaggatgccattaaggtgtttacggatgctgggtatataaatttgctaaagaaatattcacctgcggcttggagttattgttatcgtggggaggttggctatttggatcattctttaagttctcctacgctgacttcacaaatagttggtgctgctccttgggatatcaatgccagtgagcctgcttattggggatttaaatatacatcttattatagagaagatccttatcgtagttctgatcataatcccgttataacatgggttaatttggaataatttcttgggagaaaagaagcaagcaccataggccgatagttttttctttttggagatatgaatttatcggcttttcatccttttagggaagatggagatattcttttcatgaagagataaggatagaatgtgttgtcattgtacatgaattgtaagtacaattggaacattaacaatttattagcagataactttcttaaaatccgctttttttcgttcctttgtattgaactgctttcaacagaattaaaataactttaaatatcaaacgcttatgtgtagtgaaggattgcgtgaaagatatgtaaatccctatacgaactttgcattcaaattattgtttggaaccgacttgaacaaagagattcttattggcttcttgaatgccttgttcgatggcaagcaggtcattgaggatgtcacctacttgaatacagagcatctgggcagcaaagagattgaccgccgggctgtctttgatgtctattgtgaaaatgaaaaaggagaaaagattctgatagaaatgcagagaggggagcaacagtttttcaaggaccggagtatttattatgctacctatcctatcagggaacaggctattaaaggggaaatctgggactatgaactgaaagcagtgtatgtgatcggtatcttgaattttgccttggatgatgtttcgtcttccggcttccgccatgaagtgaagctgatggatacaactactcatgaagtgttttttgacaaactgacttttgtgtatctggaaatgcctaaattccataaaaccgagcaggagttggatacgttgtttgataaatggatgtttgtgctcaagaatctggcccgtttgatggaacgtcccactgcccttcaggaacgtgtgttcaaccggctgtttgaggctgccgaaattgctcagttctcaaaagagaacctttatgcctatgaggagagtttgaaagtatatagagattggaacaatgtgattaatacagctattcagaaaggcattgcagaaggtgaatggatgaaagccaaagctattgcaggaaatttgaagaatgccgggctttccatagctgaaatcgcaaaagttaccggagggacattcattaaatattacaaaatcagccaactaattcatacacaaagtattgttggaaacaaagataacaatttataaatttacccctcagctttttacattgaccccagaagtacgggtcagcggattttcctggttggtaagctttcttttaagtgtatagcctagccagtctgaacatgaagaatttcagggtcagcggattttcgggtcagtttgaaaacttgggatcagttgtaagttttagatggagaagtatgagaaagtgatggcagcatcctttttcaacacataaaacaaggagctgccaccacccctaaatctttttatccatcagtgtttccgataaaaggtggtagcagtggcagcagattttaaaaactctattgtggaactttccggcaaatacagtctgtcagatgatcgttgataaaacctgaagcttgcaaatgggcgtagcaaattgtagtcccgaagaacttgaaacctcgttttttcatatctttactcatggcatcggattcgggagaggataccggaatctcgctcaatgaccggaatgtgttgataatcggctttttgtcgggaaagaatgacagggtgtaattataaaaactgccgaatcccttttgtacggcaaggaatagttttgcattcgtgattgtcgatttgattttcagacggttttttacaattccttcaaattgcattagccgctcaatgtcttcatcggtcatttgtgctaccagttcggcatcaaaattatagaaagctttacgatacccctctctttttctaagaatcgttatccagcttagtcctgcttgggcactttccaatacaagaaactcaaacagcgtcttgtcatcggtaactaactttccccactcttggtcatggtatttcacatacaattcgtctgttccgcaccaaccgcaacgtccgtttgttatatcttgcataattctaatatttgtgatatagaacaaatgtagtggattcatggcattatgccaaatttaaaaggactattttgtggcataaatacctataaaaagttattgcatagtatatatattccgtaaaatgggggaaaagattacctatatcaggtgattgtttccccttttctttttacggacctttgcattctcaaaaattaagaatttagaattataggtattcatggtaaaaagacagttacaaaggatcagtttaggctctcttttttttataatcggagcgatatctatctttgcacaacctaagacaatggtatccggtaaagtaatatccaaagaaaaacaggaagtcgtagattttgcaaccgtatatttgaagggtacaacttatggatgtacaacgaatgaagaaggtatctatcatcttcatgcaccggcagggaaatacacgctggttgtttcggctataggatataagactatagaaaagcctgtaactttggttcatggtgaaagaattaagatgaatgtaatgattgacccgtcagtgactgagttgggtgaagtggtagtggtgtctaacggggtttcccgtgtgaaacgttccgcattcaatgcgatagctgtagatacaaaagaattccagaattctaccaagaatctgagtgatgctttggctaaagctccggggatgaaactccgtgagtcggggggggtaggttcggatatgcaattgatgttggatggtttcagtggcaaacatgtgaagatatttattgacggtgtacctcaggagggagtagggagctcttttggcttgaataatattcctgtgaattttgcagataggattgaagtgtataaaggggtggttcctgtaggatttggcacggatgctataggtggtgttatcaatattgtaaccaataagaagaaacgtaattggtttttggatggctcctattcatacgggtcgttcaatacgcataaatcgtatgtgaatttcggacaaactttcaaaaacggctttacttatgaaataaatgcttttcaaaactattcggataatgattatcaggtggacgcaccggtagaggactttgaaaccggaagaattgataaagataaaagggtacgtgtgaagcgctttaatgatacctatcataatgaggcggttataggtaagatgggtattgtggataagaaatgggcagacagattgatgttgggctttacttattcacacatgtataaggagatacagaccggagtacgtcaggaaatagtctatggggaaaagcatcgtaaaggacattcgttgatgccgtcattggaatatagtaaacgtggtttattcatcaaaggtctggatgtggcattgactgccaattataataaaaatgcaacgacaaatatagatacagcttcctataagtacaattggttgggtgatagaaaattaatgaactcacccggtgaacaatccaatcaatattcacgggcggataataacaattggaatggaacattaaccgttaattaccgtctggcgaaaatacatatgctgacctttaatcatgtgttgaatactttccgccgttctaacacttctttgttggctaagatggaatcggaggatgccatagctaaagaaacccataagaatatctccggattgtcctatcggttgatgccgtctgataattggaatctctcagtatttggaaaatattatagtttgtatgtggcaggtcctatggctacgactacgaatcaagatgattatgtccgtactacccgaaacatgaattccataggatatggagctgcgggaacttatttcattctacccggtttgcaggcgaaattgtcatacgaaaaagcatatcgtctgcctactattgaagaaatgtttggagatgaggatttggaaatgggagatatcagtataaaaccggagagtagtgataatttgaattttaatttgagctataacagaacatttggcaggcattctgtatatatggaaggtggagtgatttatcggaatacaaaagattatattcagcgtaatattgcggatttgagtggtggtaaatatgccgcgaaatatattaattacggtaaagtattgacgaaaggatatactgtttctgctcgttacggttttggtaattgggtgagtataggaggtaattttaccaaaatggatgtacgcgacaatatgagaacatctatttccagcagtgcggaaaatctggcttataaagaacggatgccgaatctgccctatatgtttgctgattcggatgttactttttattggcgggatttaggaaggaaaggcaatatgttgaccgtgtcttatgataatcaatatctgcataactttacttattattcttcccgaataggctcaaataagggggattatgtggtacctgatcaattctcacacaatatatccttttcttatagtttgcaaaaaggacgatataacgtatcattggaatgtcgtaacttcacagatgagaagttatatgataattttagtcttcagaaggccggtagggctttttatggtaaactgcgtgtttgtttcggtaattaaagaattggaaaaaggagtttataattaattggatttaaaattaaatagaagaataaaatgaagaaagatttctttttgaacggatttactgctattgccatagtaggaatggcgttgagtgcatgtacggataatgagccggattacggtttgggtaccgaggctaaaggtgagtatgttattgcatcgtcggtcacagcgtctggaaatacaacgaatgtgctgcttacttctgaaacgttggataaaggtactgtttctacagtgaataatggtcttgtgaatgatggtgcaactcaatgggtgttttacaagaatcaatatctttatgcgctgacttataatcaagggaatgcaggtacgacccgttcttatatcatggattcaaataatgaagtaaaggctcgttcgggggagtttgccgtaaagagatttactacttacggtatttatgataaatatatcatgacctcgtctaccggtgacggacccacagcgtatgctgatgagaatggatatttaccaaagatgtttttgctttcttatttggacgtatctgctgaaacatttacaacgaatgatactcaaaataaggcttatatgtccgaaaacttcttgggaaatggagaatatgtaacattggccggcatattggaacgaaataataaactgtatagcgctgctattccaatggggttaagtcaatatggttcggctactgacgggggaaagtggatacttcccggcaatgaggatttggtaaagacagaagatggtggttccaacagcagcagttataaaaaaggtgaattgcaatggacgcaatatcccaataaatgctgggtggctatttttgatgatgaaacgctgacaaataaaaaaatcatagaaacagataagatcagttatgcttgcgggcgttttaaatcacagtattatcaaacgatttgggcggcagataatggtgatatttatgtattttctcctagttatgccaaaacaatggctgataaacggcaacagactaccttggatgccggagtagtacgtataaaggctggaacggaagagtttgatcctgattattattatagtatcgaagcgcagaccggaggtaaatctttcattcgttgttggcatattacgggagattatttcttgttgttgatgtatgatcgttccttgactgaaactggtttcacagctaatcagttagcgatatataaaggagaaaccggaaaactgacttatgtaactggtttgccttctgccgatttgatctccggctttggcaatactccgtatgtggagaatggatatgcctatatggctgtaactacaacagaaggatatccgtctatttataaaatagatccggttggtgcggtagcgacaaagggtgtttctatagaagcgacacaaatcagtggcgtcggtaaactgcaacctcagaactgagtattgtaataatataatgggagtctgcgggcagtatgtgcttatgcagactctttttatgaatcgtatcgaagattttatgaagaaaatatttcgccaaatacatctttggctttctgttcctttcgggttaatcatttccttgatttgcttctcgggagccatgttggtttttgaaaatgaagtgatggaactggtcaggcatgaactttattatgtaaaaaaggtagagacagtttcacttcctgttgatcgattattggaagaggtagaactcatgttacccgacagtgtgtctgtcacaggaatcaatgttttctctgacccggaacgtgcttggcaggtgaatttgtccaagcctcgtcgtgctttcatgtatgtggatcaatatactggtgagattaaaggtaaatatgaacgtcctgcattttttgtgactatgttcaggctgcatcgctggctgttggacagtatgaaagcggatggcggagtcttctggggaaaaatgattgtaggtgtcagcaccctgttgtttgtcgtggttttgatatcgggtatcgttatctggtggcctcgtacacgaaaagccttgaaaaatagtttaagaatatctgtcggcaggggctttagaagattttggtatgacctgcatgttgcaggtggtatgtatgcgctgttttttttgttggctatggcccttaccgggctaacatggtcttttggatggtatcggacaggtttctataaagtgtttggcgtggaagtacagcagggaggtgctcatggtggggtgacccagcgtggggggaaaggcggcgaccaatccggaaagaatgtttctcattcttcgtcctatgtttgttggcaacaagtttatgaacaattagccctgaataatcccggctacaaacagataaccttatcagatggggcagcaaatgtttctttcaataccttcggtaatcaacgtgcttccgaccgttataaattcaatcctcatacaggtaagattaatgaggtagttttatataaagatgctgagaaggttggaaagattcgcggatggatctattctgtacatgttggtagttggggcggtatgcttacccgtttactgacgtttatagcagctttgataggagccaccttgccattgacaggatactatttatggataaaacgtatttggagaaagaaagtaagagtaagttgaatatctttgttataagattagggggcgaaaagaattttatcatatgacctgttgtcgtgaatgacaggtcatatgatattgttacaggattttttagaaccactttatctttctgaaaataacaaaagccaacgcagataatgtgatggacgccaaaataataaaactaaaagcatgtggtaatgcatctacatgtacatctacattcattccatagaaactagctattaatgtgggtaccatcagaatgatggaaatactggtcatgcgtttcatgatggtgttcacattgttggatatgatggaagcaaatgcgtccatggttccggttaagatatcactgtagatattaaccgtgttatatgcttgttttaattcaataactacatcttctaccaaatcgcggttttgataatctttttcctggaagatactttgcaatttacctaccatcacctcatttccacgaatggacgtattgaaataaaccaatgttttttgtagtttcatcaatctgagcaggtcctcattacgtatgctcctttccaattctttttctgcggcagctacatcattgtttatttgtttcagatatttcaagaaccatacggcagatgagtaaattaaccgtaaaatcaattcaaatttattaggcacaatgattcctttacgtcgggtgtggtcaataaaatcaggaatcatttcagtggagtgataacacacggtaacaatgatttcattatttgtaatgataccgatggggatagtgatataagggatgcttccctgttgttgcagggggattcggataatggtcagtagccagttgtcttccgtatccgttctcggacgttcatccatatcggcgatgtcctctaaaaaagcttcgggaacttttaattctttagtcagaaactcaaaatcactttggtcggggcattctacattcacccagcagtttggcatccattgtggcttttctacaaagccattctcacaataaagatattttctcatcttattgcctcctttcgttcgtttatatccgttcagaggcattcagagtagtgattgccctgtcggatcagttaatactattgcacgttcgtggtattgaatcgtccatttttattgattgttttttgttttaagcggtacaaaagtacataaaacctttaaaggacagacagaagtcaggaggcttttatattttttttaagaatatcaccggaaagcaatcagtgccggagcaatgatggttttgtcgccatagcgcagttctaacgtactgtgtttaccgattaagttccctggcggaaactattgttgttaaaacatttagcatccttttaattacatgcaaaattcacttaaaaaatcgtttgtccaatacctatttatgatgaatcttgttctatataatcctaataattaggtattgtggaaggtgctgaagtcggttacctttgcaaatgtaataattacaatttaaaaattagttttaatttaaaaataaaaagagtatggaaccaattattaattcacaagttcctgaatttaaagttcaggcattccataatggagagtttaaaaccgtaactaataaagatattgaaggtaaatgggctattttcttcttctatcctgctgactttacgtttgtatgccctaccgaacttgtagatattgctgaaaagtataatcagttcaaagaaatgggagtggaagtatattctgtaagcaccgattcacatttcgttcataaagcatggcatgatgcgtctgaaagtatccgcaaaatcacttatccgatgttggcagatcctacaggtgctttgtcgcgtgcatttggtgtgatgattgaagaagacggtatggcttatcgtggtacttttgtagtgaatcccgaaggcaagatcaaattagctgaaattcaggacaacagcatcgggcgtaatgctgatgaacttcttcgtaaggtagaagctgcccagtttgtagccactcatgatggtgaggtttgtcctgctaaatggaagaaaggtgctgagaccttgaaaccgagtattgatttggtaggtaaaatttaaagtatagaactcatgttagatagtgcgataaaagatcagttaaaaggtctttttgcccaattggaagcgcactatacttttgacatctttgtccaccctcagcacgaaagtcgtgccgagttggtggacttgttggaagaagtggcttcctgttcggataaactttcctgtcggttgcaggatagtgaagggctgaagtttatccttttaaaagaaggaaaggatacgggaatcacatttcgtgccgtacctagtggtcatgaatttacttctttgttgatggctgttctgaatgctgacggcaaaggaaagaattttccggacgagtttattaccagacgtatcaaggcgttacaggggccgattagtttgaccacctatttgtctctcacctgtaccaattgtcccgatgtggttcaagctttgaatatgatggtacttctgaatggtcagatacgccatgaggcagtagatggatctataaatgaagaagaagtagaacggatgaaagtacaggccgttcctactgtatttgctgatggtgaacagattcatgtggggcgtagcagtatgggggatctgttggagaagctggaagcccgttacggttcggtggaattggaagctgttgagacaaaagaatatgatgtactggtagccggtgctggtcctgccggtgcgacagctgctatctactcggctcgtaaagggttgaaagtagcaataatagccgagcgtattggtggacaagtcaatgaaacgatggggattgagaacttgatatctgtgcctcagactaccggtaaacagttggcccaggatctgaaaaaacatttggcggaatatcatattgatattttagaaaatcgccggatagagaaagtggaagtggcagagggcatgaaagtgttgtctgtgaaaggtggagaaacgtataaggctcccgtattgatcattgctaccggggcgaattggagaaaattgaatgttcccggtgaagaaaaatacatcggtcatggagttgctttctgtcctcattgtgacggaccattttataaagataaggaagtagcagtcataggtggtggaaactccggggttgaggctgctattgatttggcgggagtctgttccaaagtgactgtattcgaattcatggatactttgaaagcggatactgttttgcaggagaaagctaaaagcctgcccaatgtggatattattactaatactcaaacggtagaggtgttaggaaacggtgataaagtggtggggcttataaagaaagaccgttcatccgaaaaagaagagatctttgccttggatggtatttttgtccaaataggtttgactgccaatagcactttgtttaaagaattgctggaaacgaaccgcatgggtgaaattctgactgataaaaatggccggacctctgtaaaaggtatctatgctgccggagatgtaacggatgtttcctataaacagatagttatagcaatgggggaaggcgccaaggctgctttagctgcattcgaagaccggatgcgcggaacgatttattagtgataagtggttggtggtgaatagtgggtgcatatcgcagtatttaccactaatcttatcactaaaaaatgcactctttgtatgtatattggtgagaatatgctttctttgtaggtgaatcaccgtttacagcattgatatggcagaatcgagacgtacttcattgaaagatttggcacagatattaggtgtatccatacctacagtatcccgtgccttgaaaaatagtcccgaaatcagtcgggaactttgtattaaagctcaaaaattggcaaaagagatgaattatcaccccaatccttttgctatgagtctccggaaaaatactccccgtaccattggagtaattgtacctgatattgttactcatttctttgcgtctattttaagtggtatagaagataccgctatagcaaacggctattttgttatcatcacgacttcccatgagtcatacgaccatgagaaaagaaatattgagaatttggtcaatatgcatgtggaaggtattataggttgtttatctcaagaaacaacagattatgcccattggttgagtttggatgatatgaatatgccgcttgttctatttgatcgtgtttgcatgcctgaccgtttttctacggtagtggctgatggagtatattctgctcagatggcgacacagcacttgttggatcatggaagcaaacggattgcttttatcggtggtgcaaaccatctggatatagtaagaaagagaaaacatggttaccttgaagcgttaagggaaaataagatacctattgagaaagatttggttgtgtgtcggaaaattgattttgaagaagggaaaatagctacagaaattttattatcgcttccggagcctcccgatgcaattcttgccatgaatgatacattggcatttgccgctatggaagtgattagaaatcataatcttcgtattcctcaggatatagcgcttattgggtatacagatgagcaacatgccaattatgtagtgcctcgcctttcggccgtctcgcatcagacttataagatgggggaagccgcatgtcagatgttgattgataagattaagggagataaaaaaatcaggcaaatcattattcctacttgtttgcaggtgagggaaagcagtataaaaaggaaggattgagaaccgaaatgtattttaagaagagaataaggctgaactcttcacaaagagccaaccttatttctttatatattggagtattattgagtgaccaacgtaataatggaacgtgccgggatcacaactttttcatggtttttgatgcttcctaccggtagaagattctctccatctttatccgaagtacgatagattgtccagttttttataattccgttacgctgatagaaagtaaactctttatcttccgctgcataattaatcataacgaaaacctcctttccgtctgtattttggtatgctgaacacattagtccggttacatccgtatcgccttcaggaatgattttcccttggttgtctttggctataattgctttccgaacagctcccgggcgtataaatctactgtagtttcccaaagcccacattaatttggagtctttcacctcaccattcagaaaagtcggatcactatactcacggattaatccgtctttataatctccaccgatagatcgccaccattgccaactgcgagcacctgcatatacaatgtcatgatgaatgatccgtgctacatataatgctgtcttcatggtgaagtcatatcctccgcctccgccgatttcttcgtcattgcccatgatacaggtttctgtctgccagaaatccaccttatacttgtctaaagtatcttttaattgacaacggatatcgtgtaaattattcagaggagtattagtccaataactatgccctaccatcagccggggaacattgggagtatcacccagataggtggctgtactgtccggattaaagaaagactggatttgatacccccgttcccaattagtcatgtgagtatcgaacatacaacgatagtcagaggactcattgactagaatctgtgtgtcaatttggttatttacgaactctttactgatgaggcgtatggcacgggctatttcgcggttggtagccggtgtaccttcttgtttggggccaatccagttccaatgcccatcgggttcattgaatggacagaggtaattgaacttgattccatcgtgtttctccaccccttttatgacattggcaagaaaacgggcaaaattcttataatgctcttcctttaagtttaaggttcctccacggcctgtgttggtggcaagaccgttttgtgtgaaatatacgggaggtgaattaagaaatgccaaaaatttgtttacaccccgttcttttgccagacgcaggaagttgcgctgcccttgttgtttattccaattatagttaccatctgcctgaaggaaacattcggtgcgcatccagggagaggctatctggctggcttctccttgttccgcacttccggctcctacattgaaacgccataaagacaagccgattcctttaggttgtccgttttcatggttttccgtactgaacagccagtcggctacttggttttgtttttcttgcggccataagccgataaattgcatgctccaacagtctgatgctccgaaatagtccatggtttgacagggttggtctgtttctatttcaaagtgaatggcaggatgttgagcaaacaggtttgctgttgcaaataaagagaataataatgctttgtatttcataaagttgagggattatttcagattataaatgacagttgtaacactttccgaaggcacaattacttgttggtctgccgtgacgtgtacctcttgcaaatttttgttatttgttgttgtataagtagtgatggagcttatttcacttacccattctttatgaatttcgtttagccggactcctttttctgatagattggtataaacagcaacaattttatcttttttcggtgaaatccatgctgacccgaagaaactggatgattcattcatgttaagcatgatacggcgataacccggtcggatgaataggctgtagttacctaatacccaaagtgtgggagtagctttataagtgccttctttctctatatccccataaactccatcggagggttccagtgaaatcagtaagaagcggtttttgtgtccccagcgggggatatccattgaggtccagtaactccaggaggaaactcctgctatagttaggtcattgtgtattacttttgacatataaagtgcaatgtccatttcggttgcttggtcatagcctataaactcggaagagctgtatccgtcgcctaacatactccactcactttgccatatttctacatcatattgttgggctgcttgggccagttgtttccggacattacgcataccatcccatgtgccatctgtccagtagctgtggccgcagataagtttctttacatgagtcaggttgcctatataggtggaagttccaggtgtgaaaaatgctgaaagtacgttactatgggcggcatcattcttaaatttgtagagatattcataatctccagattcccctggaagaatatcaatagaaagaccggcagaagtgatggcggtatccaattcacgtataagtctggctacttcatcattagtccatccgctgccttcctggccgctgtcccaattatattggggttcgttaactggtgagatatgtgtcactggatatccttcgtttacatagtattttgctacatctgacatgtatctggcaaagtccgtataacattcatccttcaaattagaaactcctccgctattggagaatccttttccgttggaggtatattgtacaggaggggtattgctgaaaagtactatactctgacaaccaaactctttggcgcgctgcaagaagtagcgctgccctttacagcgtgtccagtctaatgttaagtcatcagtcagataagattctgctctgcgtgatttgtcttctattccacttgcttcaccttgttctgcactgccaccacctagattcacacgccacatggagagtcctatacctttaggttgtcctgattgtatttcagaagagaatagcagttcactgattttgtcacgattcgttatccagctttttcctacgaaggcaggtgcccaacaatctgatgcgccaaatcctgtcagagtctgaaaagattgtccggcatctatggttactgttttttctacgtttatgctgctgtccggttgccccgatgtatccggtgtttggggagaatcgtcactgcaggctacagtagaaaagaacagtggaagagtaaaaatatattttagtttcattgttttagatggattaaaaaatagtcgcggataatcctagcaaactatccgcgacagaatataaagacctattgaatgtttaattcctgtaacaatctgttctttttggaaaatgattaattccagcccggattttgggtgatagaaccattagacattgtaatctcatataaaggtatcgggaataccatatcccggttttcgttgaagctgattcctttatcacttgcctcaccttgattttcccattcgtaaatgtcgcgggtagcgggatctgtattgtattttacaaatgtaccgtttgctcccatcaggttacaaatcattttcttgccattgtcatctgtccaacggcggatatcatagattctgttttgttcccatgccagttccaaacgacgttctagccggatagctttgcgaagctcgttcccactggatgtgacagcaggtaattttacacgattccgtacctcattaaggtaggtacgtgctgtaccatcttcgcccaattcgttgcaggcttcagcatacatcaacaatacatctgcatagcgtaagatacgatgatctaatggaattttgtcgatattgtatacttccggacgtttttcaataggtacaaaatacttccggacaatacgtgctgatttatgttgtgacggatctataatataacattcgggatcccaaccgtacttttcgatataatctttataattggcgatttttgtgttgttttcaacgaacttgtcgaagttattctctccggcaatttctgtacaaccggttttaatgatagtccaacgtaaacgttctgtatctcctgcatcgatgtaggcttgttcaaggttagcggttggctgtccccaagaccatccgtcgccgggaccactacgggcaccggtaataacagtcaaagaaccacccaatgcataagttccatcatacatatattgtacttcaaacagactttcttcgctattgttatggtcaacatcccatacatcaccgaagttgtcgagtaatttatattcaccttcgtcgatgactgttttcaatacatcatgtgcctcttgccatttgctttggtagaggtaaacctttcccaataggcctaatgcagctccacgggtagcgcgtcccatatctgtagcagcatattgactacgttgtggcaacacatcagcagcggcttttaaatcatcttcaatgaacttatatacatcttcggccgaagcgcgggtaataccttgtatttcttcgggcaacaggaagcctgtaatgagaggcacaccaccaaaattcttcacaagttcaaaatagaagtatccacggagaaaacgtgcttcggctacaagccggttcttcatttcttcatctgagaaatcagcttgtgaaatgcgttccactgcgatattgcaacgtagaatgcctttgtatcgatactgccaaaagttggagatggcaccattgctttgtccggtaccttgatagtgggccaaagaaatatagtcactttgactttggctggtattgcccatccaaccgtcatcactacacatctcggaaagcaaccatactgtgttgatattccaccatccgccaaaagtaatggcctggtaacaaccagtaataaatgcttcggcttcttctgcactttggaaataagtatccaaattttgttgcccgcgcacttcctctgttaggaaatcctcacaagaagtgaatgtcagcgaggcaatcattgttaatattgttaatatctttttcatggtttataccttgagggttaaaattttaaatcaattccaaataagaaagtacgtgggttaggataagcgatgccgtcaataccggtttcaattacactgccatctttaccaatctgtggacgttcaggatccatacctgagtagctggtgatagtgaaaggattttgagccgacaatgagagacgcaattcggttccgttcaaccacttcttggggagtgtgtaacccacttgtaatagtttgcaacgcatataagagccgtcttctacaaagaaacttgaaacgcgtgtgtaattctgattcaaatcattgtaggacagacgaggaatatcgttgctggttccttcgccatgccatgctttctgcaatgtacctgcccaaacgttttgcccacttacgccggagtataaacctttggtcttattgaaaatatcattaccgaatgtaccatagaagttggctgtgaaatcgatgtttttatagctgaaacccaagttcaaacctaccatcaaatcgggatatgggttaccgatccatgttttatcattttcatctagaactccgtcatgattcaaatccttaaagcgaatgtcaccgggttgggcattggattgtaccagcttgccattttcgttggtgtgagcataaacttcatcccaattttggaaaataccatcggctacgtagccgtagaagcgtgaaatcaagccaccgtcttcattacggataatttggtcgctgttgaaacctccagtttggataggaccgtcaccggagaatttaacagctttatttttcactgcggaaaggttcaatcccacattatatcggaagtctgctactttgtcgtgccagttcagacttaattcccaaccgctagctttcatactacctatattcatccatactgtactgttccagtcggggtatccgatggcgaagatattttgtttctgatagagcatatcagaagatttcttttggaaatactcaaaggtcatgtctagacgggagtcaaggaaggacatatccacacctacgttccagtcttctactgtttcccattttagcaaattattgccaacgcctgataccatagtacctgaaacacgtcctggagctgtaccgaatacataatcagattgtcctaacaaagtcagcgtagcatcattatctatgttttgattacctacacgtccccaacctccgcgtaatttcaagttactgaaaatcttctggtcttgcatgaaactttcactgatgatacgccatgaagcagaaacagaagggaagatggcatatttgtttcctttggggaaacgagaagaaccatctgcacgaatagaagctgttagatagtaacgattgtcatagttatacatcacgcgtcctaaataagatactaatgtgctgtaagcagttttaccttctgacttttggttttgtgtaccggcatttacttcctgcatttgatccatattattaggaacatcgtcacgtgaggcttttgattggaattcagcaaagcgttcagctgtaaagccacccattacattaatattatgcttttctgcaaaagtcgtgatgtaagtagcagtattagtccagttccaatcaagccattcctgcatttcacgggaaacattacttaatgtagattgttccaaagcatcaatatagaattcaggagtgaatttgtctgtacggcggaagtgtgcattagcgccgaactgcgtgcgcagggtcagtttttgaatagggtttatctgtaaataagtatttacaattgtacccatttcacgggagtgggaattttggcgagccaatgaaccggcagggttccactcctggttgttgtaagaacgctgatagttattgaattcgttatccacccattgatcttccggcttgaatataggagttgtggggtccatagacatggcagctgaaaaaagatcgggggtatcatcccatgattctacacgtggggcaatgtcgaaacccatttttacatatttattaaatgtatattctgtattaaggcgtgcgttgattttgtcccaataaccatagtcatattgtgaattgttacggtagtaacccatactcaggttataaaccagtttgtctgaaccaccggagatattgagtgagtaattttgcactaaagcagttttgttgattacttcgtcccaccagtctgttcctccgggattggtagtagcgcctgtatcattccaaatagaagttcctccgtcatttgtgtatcgggtattgaatacttctttatattcggcggcattagccattttgggttttgacagtgtttggaaacctgcagatgcattaaaactgatatttgtttttcctgccattccttttttggttgtgattagaatgacaccgttagaagcacgtgttccgtaaatggcagcagccgaagcgtcttttaaaacttccatagattcaatgtcattactgtttaggaagttgatgtttgtacctaccggcatgccatctactacatacaaaggatcggttccgtttactgttgttacaccacggattagaacttttggttgtgcgcccggaccaccaccactggttacttgaacaccgttgattttaccttgcaaggcgtccattgcattaccggttacagtttcggtaatttcttttccttttacggtagatatagaactggtcaggtcactttttttcacggctccataaccaataaccactacttcgtccagtaattcactggcatctttcagcactacattgataacggtttgtccgtttacctttatttcttgagtctcatatcctatgctggagaacacaagtacggcatccttggcaacatcgtttagtgaataatcaccatcaatacttgtaatagtacctgtacctgtacctttaacttgcactgttgcaccaatcatcggttctttatctgaagccgaggttactacaccttttacagtgatggtctgcgcatagctacatagacttgtcagcgcaagacacaataataatatttgctttttcatatcttaaatctaatgttacttgttaattggccggaatgagtttagctctttccaaatgagcgtcgaatataagtttataattccctgtgacgttcactgttggttttgcccaattgtcacctacatgatcgggtttggtccatgccggattggtatatttggcttctttaccataatatccgaagatctccggttcgtctgagttgtctacacgccacgtgcaataattccaccatccgtcagagtgccagttatgaataacgaaattcattttagtacctgcctccaggaataggggggtatccaaatagaataggtgaggattggtcttatcttgagtgaaacgcaggacttcagttgggctactggtcatatatccgaaatagaattcctgtaaccacgaaccaccgtcaccccatgtgtcaaggctgatagaaccgtatgtgtgaggtatggggtctacagcatcggcaattgagtaagttttcagattgtatgtactgttcttcacatcaatattaatttcataataaacattggcttggtcaagtacgattggcattgctgtttcgggatcgtctgtcagtttggtgttatcctctggatcaagcccgaaacaaataggagtgaagtcactcttttgtggtaagaagaatattttagttccggctttttgacagtaataatttgctttatactgatattcacctgtatgttcaattaccatcggtaccccgaatatatcactattcagttcttcggcagttgccacatctgccagatacattttgggaaaatccggcatttctgagatattcaatacactggtggtagtggttgagttttctttcttgtcaaaagcggtaattgtcacattataacttttcggttcattggggaatactattatttcggcaaagttcaatgaactttttccatcagcatctacacggcggttgtcaaacccgtctatacctggaatattaattgtgacataatccaatgcacgatcatctgtagccgtgaaccgaagattgaatttcgtttcatttttcattaatactgtaacagtggcatccggggcagctgaaaataccggagctgcaaaatctccgtccattgtgattaatacatcttgagatatactgcgtcctcctacatcggttacagtaactttgactgtgaaacgttcgccgatttcatttcggtttatgtcaaagtaataacttaaatcataactctcttgcggagcaccatagatttcgattaaatcaattgtcttgttcaaatgcaggtcggcacattgtaggctgatagaagcaataccgtctttgtcttctaatgtcccttcaatagtaaatcgatgtcccgctccggactcgatgtggtctgttgctaatgtcattgttggattttgtccgtctacatcggggtagtcgttatcatcactacatcccgtacataggtttgcagttacaagaaaagcccataacatggcaccatacaaatgtttctttttcatattttattagtatttgaagattaaacatctactctaatagaggacgaattaaattcgttagtggtgcaaatgtacgtgaagaagaattaaaatcctgatataaatcttgcagaaaagggaggtaaatcttgcaatgcatgatttatgtatctaaaatacagactttatttgtatttttgaaccatattatttaacaatgtgtacactgatgctatgagaaagatattcgtactttggctcttgctgctgtcggttgtttcattggcacaaccttattctgttaagcagcttggtatagagaagggattatccaataattatgtggtgagcattgctcaagacaaacagggctttctgtggtttgccacggaggaagggttgaacaaattcgatggtacccgtttcattacttatttgaagaatgaagatttgacaaggcagggtataacaggcaatgaactgaattgtttgttggatgatcctcaggattctatcctttggataggcacgcaaagggccggtctgaatgcgtatgactatgtaaataacacttttctttgctataggcatgatggcgagaaccccgaaagtctgataacggatgatgttactaagattgtggcagctacagatggtaatctttggattacgacatattggcggggagtagattatttcgataaaaaggctggaaaattcattcattacaatactcaaacagttccgggattggctagcgataatatttggtcggttgttgatggaggagatggaaagttgtatatggggcatgtgcatcatggattcagtgtgttgtctcttaaagataaaaaagtaaagaactttatgcatgaccctgaagatccggtcagtttgccaggtaatggggtaacttgcatttataaggacttaagcggtaatatttggctgggaacagaccgggggctggcactgttcaatccggaagccgaaaattttatccattttcatcatagtgaggacggggttcctcataccgtatttgatatcagacaatttgatgggaataaactttggattgccatggaatttggaggaatagccattttggatttaacgcaacgtatgtttctttctcctgaccaagtgcgttttcaatatataaaggaaggggatgatgaatacagtctctctaattctactgtacgttgtttgtttcaggactcctttaaaaatgtatgggctggtatgtggggaggtggaattaattttcttagccatgaatcttcctattttaatgtttatagttattctcctatccagcattcgggtagtagcctgaataataagacagcaagcagtgtatgcgtagcaagggatggaaagttatggatcggaaccgatgggggaggcatcaatgtatttgataaaggcaagcgggtggcggtttataaagaagaaaccggtgatttgactgataattccatacaggctgcactttgtgattcggaaggaaacctttggtttggatcgtttatgggaggagtggatttttatgatgtgaaaaagaaaagttttcaccagatttttcctaaagataaaacaggggaagatgtgcgtgcactgtatgaagatgcagaatatgtatggataggaactagtaatggcatctataaggtacgcttgcatgataaaggcattgcagaccattatacagtagagaataatctggtgagatgtatctcgaaagataatcttaatcgtttatggattggtactttcggaggaggattaggggtttttgatgaacattttcagtgcgttaaactttttaacgtgacttctctttttccctctaatactatcaatactgtttatatggatagtcagaacagaatgtggataggaacgggagaaggtctggtttgttttccatcctctcagagttgggactataaagtatatcgcagtgaggaggttttgtccaatgtccatatacgtgccattacggaagataatcatggaaatatatgggtgagcaccaataaaggtatcagctgcttgttgaaagacaaggaggttttctataattacgatcattgggataatgtgcctatgggcaatttcatgagtggaagtgtggcggaagctaaggatggaacactttattttggctcaatcaatggcttatgccgttttaatccagatcaggtattggaaaaacgagagtcacctgctgcaattattacggagatgcgtatattcggcccgttgcgtgatacggacagtaatgaaaaggtgatggcgcttgaaggccagtcggaagtacgtttaagctatatgcaaaataacttcagcgtcaccttcaatatacagaattatgccttggccgatcaagtggaatatgcttatatgttgaaagggttggaaaattcatggtatacagtaaccgatcctaataatgtgactttccgtaatatacctccgggaaattattgttttcaggtaaagacaagaatacggaatcaggaatgggcggatgagatagcttctctggatatccgtattgacccgcctgtatggcttacgtggtgggccaagttattttatattctttcgggtgtttctgtcctgtattttattcttcatgcctataaaaagaaactggatatggagtctctctatgagttggagaagaaaaatcatgagcaggaacaggagctgaataatgagcgtttacgtttctataccaatatcacacatgagttgcgtactcctttgacgttgattctgggaccgttggaagatatgcagaaaagtaattctttatcagggaaagattcacagaaaatatcggttatccatcaaagcgccatccggttgttgaacctgattaatcagatactggagttcagaaaaacggaaacccaaaacaagaaattatgtgtaagtcgtgacaatctggcagcccttgtacacgagatcggactgaagtataaggaattgaaccggaaacctgagattgatttctgtcttgagattgagcaggaagatatgtctttgttttttgataaggaggtagtaacgattatactggataatttgatctccaatgctataaaatatacagagaaaggaactataactttaggattacatcaggtggtccggaataatatacaccatacggaaatcagtgtgagtgacaccggtttcggtattgctcccgatgcattgcctcatatttttgaccgttattatcaagagggaagcgaacatcaggcttcaggaacaggtattggtctggctctggtaaagaacctggtagttttgcatgagggggagatcagggttgaaagttctttgaatgtgggaagtactttttatgtcagtctgctgacggataacacgtatccccatgtgctgcatgctgactcgacggagaaaacttccgatgaaaaggacgaaaaagaagaaaatatagaacctgtgcatagtggtaagcgtattctgctgatagtggaagataatagggacatctgtgattatattgtagaatctttctcggacgattttgaagtgaggactgccgccaatggtgaacaaggtttggaacaagcattgggctgcattcctgatattatagtcagtgatatcatgatgccggtgatgaacggcattgtgatgtgccggaaattgaaagaagacttgcgtaccagccatattcccattattttgctgacggcaaaggactctttgcaagataaggaagaggggtatcaagtgggtgctgactcttatctgacaaagcctttcagtgctactttgttgcatagccgtatccataatttgcttgaatcccgcaagttgttggcagagcgttttaatacgaattccatactcattgacaaacgtgcggcagtaaccgagtctatgaataaattggataatgagttccttgagaagattaacaagctgattgaagatcgtctttcttctgagaagatagacatcggctatttgtcggacgccatgtgtatgagtaattctaccctatatcggaagatgaaggcattgaccggactttccaccaatgaatatatccgcaaaataaagatgcaatatgcggaacgtttgttattagaggggaaatacaatatttcagaagttgcgttcaaggtgggaattaacagtacggtctatttccgtcagtgttttaaagatgaattcggtatggctccttctgattatctgaaaaagataaaaccggaatagagtggttgtgtaagccgtttcttccatatagttaagcttttttttacagtcatctgctacagactccgccagtggactgtaaggtctgcttgggtggactatacagtctgctgcaatggactctacggtccattgagggagtctgtagtaggtaaccgtaagaaagggcttaattgtaggcaagaaaagccttagctaatagggagattggactttgaaggaaattgctgtttctcaatttgtatgtttataaatgattgtagaatgctttcaccgtttcccatttataataaggggcaatagggctgtcaatgggtaatttgacttcattttcattatgtagcaattttacaataacttctccttgtttattcttgaaaaagattaattgaaggttggctcccataggtgaaacacggaaatcttgccaggccaggtaatatcggtcgggatctgtttcttgattggagcatccttctacttgcatgagtgccaacagacggatcaggttggtatcatgtccgaaacggagggtggcgcaaggagttccttcacggatggcgcggtcggcactttctataatattcttcaataaagattttgcactcttgggggctgctccctgattgacgggagcattggcattgcaaatatacatccgataattcacagactgccagataccgaataattcttctttttcaaacaaatcataaaaggatagaggcaactctacatcttgcatgtcggaagcaatccaataaagtcccatcatgagctcgcggggattcctgacttctttgggatttttgaaaagtgaagcgattaaacgttccggatgaatatgattttcttcgaatgtatggaaagctgttctccatggcgcacttgccgaacccagcttttcggcttcgggtgaagtataggcaatgtagtccatgtgtctttggttggcttcgcgggtgatctggagggaggggtttagttctttcagttgttctgtgaatgcggacatgctcatgatacaacgtacggaaacgctcgaacgcgctgatatgttggcgctgtcccggaatatatggggatattgttgataaagccgtttggcaatggctttgtgttgtcgttctcctaatggggtcaggtttcctccgcgcccacgggcattttcccatactttctggagtctgagcctcacatcttcacctaaatcggtaagtcctgatttattgtgaaacgtatcaaagacacgaatgacttctagataacgttcgtccgaagtcatccagcgggacccatggcgtccgtaatggctgatgtagaaaggactgtaaccttcgggtaccggagtttgtatgccgtttggtgtgggataagcataatagatgctacccattttttccgggctttggatgatttcttctttcagattgtgtgcggggagatctatgggagctactttccaattgatgccgagcggattattttgtatttcccatatcagagggaaatccggattatccataatccacatttcgcatccgtctactgagtcgtttacatgcagtaaggaatagcccatagcttgtgacttggtatcagccagttggtattctgtctgattataatgaaatgccttttggcttttcaattcctgaaaagcggttgctgaaagtagggcaaaggtttcttgaatggggagacagatatgctgtccgtcttccggctgtaagaagcttagtctgaccgccgtttttaaagcttcttggggcatggcgtagctgcctgattgccatcgggtgtttctttcaattccccaatgcagataaagggtgtcgttggactgattgaaagtaaattggtactttcgggtttgtccatgcagtttgaatacaaataacagagggttggtaatgatatcttgtgccattacatttcccatcaggctgccgataagcagaaagcatataaaaagttttttcttcatcgtatgttactctttagattcaggaaatagtttgctcccccagttaccgggactggggcccatttttaaaaccaactcgcctcctttgatgatatcattatggcggatggcggaatatggataattctttccatttaataaaatcgaccggatatacttgttcttttcggaaagcccttcggctttgatcgtgaatgttttgccttcctgtaaatggaaacgactctctgtcagtagaggggtatggattaaataatagtcttgtccggcattggggtacaaccccatcatgtggaataccaaccacgatgacatggctccggagtcatcatttccgggaagaccggcagaaccgtcattatagttcttctggataatttcatggatgcggtcgccgcttttatccggacgccctacccagtggtataggcagggagtgaggaaggagggctcattattcacattgaagaaacccttgtcaaagaaaatatccagccgttcgtcaaacttctcttttccgccacattgttcaatgagtccgggtacgtcatgcggaatgctgagtgaatattcccaggaggaggcttcataaaagaacatgttccaccaaggagtataccaagggccttcaaaggtaacgggggtatatgtgaaggtgggtttctggatatgggagtttccgaaaggtattttgtctaaccagtttccttctttatcccggggaagtatgaatcctttgactcctgcatgttcataatcggcccgccacaagttcttccagttggaagattgtttcaagtattgctggtacaagtctgtcttgcctagtccttttgctactaaggctatggcataatcacaataggagtattctattgtgcggtttccggctcggggaataccgtatggaatatatcccaattccagataaggaatcagtccgcctcttccctccgtttcttcgttacctccgggcggtatggtcgcatctttcagcatagcttccaaagccagatggtaatctatgtttggtagtccttttacaaatgcatcggctataacaatttcggcgttggagccgccttgtgtccgtccgttacaatttccgcttcgtgcatcaggcatgtagccgtcccgtttatagatattgatcagtgaacgtacaatgtctgtttctctttgagggtcaatcagtgtgataagtggagttgaggtgcggtaggtgtcccagatagcataaaaatcatcataataaggttccggatcactccataatggattttcaccggtacggtctacaggcattaacatggtatggtagataccggtataaaacatacgcttatatttttcgggtgtatttgaggctatatcaatgcgttgcaataagttttcccattgtgccaataaggcttgccgggtgtcctcaaatgaccaatgaggtatttcgttccatacattctctctggctttgagagaactgataaatgaaattccgactttcagttgaatggtatttgcagaagaagggaaacgcaacaaagctccggttttttgttgggagtctggctggtatcgttcattgctgatctggtttcctttccatgtggtcgtttgtacaaagggatggtcggttactgcataaaaataaacggtgtaggcacgtccgttattccaacctccgcgaatacgggtatatcccattacttcgtgatcggatatgatttgaatttccgaacctacaaattgttgtgcttcgcgggcatcggggggcggttgttcacccaggaagaagccggcgtcaaccaacagggattttaaggaatcttcgggataggtgaatcggtagaatgaggcgcgtggagcagttgttatttcagtatatatgcctgttctctggaattcggtagcataatagcccaagcggattgtttcatctttgcgatagtctatatgattgagctgatccatacctttgccaaaaggcatgacaagtatgttgccatatttaggacctcctcctgtcccgctgacgtgtacttgggagaacccgttgacttgttcgggcataggcagccaaccactattgggatggacagtgcaatcgggcgatggtttcaccataccataagggcaggaggggccgataaatacccgtcccagtccttccgaaccgattctgggatctacgtaatcagaaagtctggcttcctgtgccgcgaccgtcacgggcagcagcaggaagaccagtcttaacaaagaaactttgaatggaatgtgggtcataattatttcttgtttatttttacacgtattgtattcttctctttgatatctcctccggcttgtgtcaattgagggaaggcccaataaatgttacagccggtaatccggatatccgaagcggtgtccagatagaaagcataagtcttgtcatatacaaaaccatctccgttgcaaggacgtttgtcatacacaccgctttcataaccggtacgttttaacaacttgacatctatttcatcaaaatagatatgatgcaccttctccggagtgtctccccctacgaaaatgccgttttcactagtgcatttaatctgattgaagaaaatgttgctgacttctcccgagtgtcctttcgttgcacctttggggaaacgccagcctgcatctttatgattgcctacggcacgagggtatgaggtgacatagataggttccgctttaccccaccatacatcagaatagaacatacagtctactaatatattggagaaaatgacattgctcacagtaccttcatcccggttttgtatgccgatgccccggttgctgtttttgataatgcaattattgaataatacattatcgatcttgtccatattttccgagcctatcttaatagcgcatgagcgtgaagtcatgacacaattagtcactacaatatcttcgcaagagccatattcttcaaattcccgacgattcttcaggcaaatgcagtcatcgcccgattcaatgaagcagttcgctatacgtacttttttggagtgatccacatcaataccgtcgccgttgcgtatttttagattattcaataaagagatgccgtcaatcaaggcatcgtaacagcctatcaggtgtattgtccaataggcgctgttccggatcgtgatgtcacggataacggttttctctacattgataagggtaagcacatgtgggcgtgggtcaaaatcagtgacgggcttcagctcgtaggaatcatccagctctttgcccataaaggcgattccgtttccgtctatttctcctgtaccggtaatggatatttgttttaagtcttttccactgatccacatcattccttcgccacggttttcgcggaatgcgctttctgtatagatgctttcatcggggttggccagcaatcgggagttgggttccagatgaaggttcacataggatttcaaatatagcggaccgcatagaaaggtgtgtccggcaggaatgattacggttccgccaccggcagcggaacaggcattgatggcgcgttgtatagcggcggcatcatctgtttgtccgtctcctttggctccataggtcatgatgtcgtacgtgttcccttgatgggaagtactgcatcctgtcacaaacaacaggaggcagcataagaggctgatgatagtttgattcttcatatgggttgttttttattttttgtacttatttcatattgtcgggaggcaggctgagggcggatgctccccagtttgtattagggttcgggcccatctggaactctaatgttcctccctgtattatatcttggtgtgtaaagtaattcttgtcatattcttttccgtttagttttgctgactggatatatatattttttttgttggcgttgtgggctaatatggtgaatgtctttccgttttccaagcggatgctcatccggggaaaagaaggacttcctattatataataaggtgtaccgggacataccggatagaatcccatagcagaaaatacataccaggcagacatctgtcctgcatcatcattacctgacagaccaccgggagcgttcagatattctgtttccataatatgacgtacctcccgttgggttttccaaggttgtccggcatagttgaagaggtaggctatctgatgacaaggttcgttgccgtgccagtagcggtgttcgctgaacatggaatccagtttggcaatgtatttttcttttccgcccatacattccataagtccgtatatatcatggggggcataccaagtataatggcagggagctccttcggtgatgaagcgggtgaaagaaaaggcgttaccggcatcggtgaggaaacttccgtcagcgtatctgccttgggcatatccggtgctagggtttattacgttacggtaatatcgtgcacgtatcattaatgtatcataaagtcctgttttttgtggatcaggaaagtaatcatctgatgtttccaacttttgcaggacttgggccaatacgaaatcatcgtatgcatattctaaagtacgtgacacttgttcgcaggtatgaaaggcttccggtacgctgtcttccaaaggaatgtatccatatttcagataagaattcaaagcacgccgtcccattccgtttttatattcttcataggtggcgggagtcctgaatgcgttccggagcattccttcgcaagctttgttgatatcaaaattacggattcctttgatataggcatctcccagtgcggagatgcaatgatcgcctatcatggctgcggtataactgttccaacaaggaaatataggcagccagccgccttgttcatatttgtccaccaatgattgcatcatgtctccggctttctttggggttaggatattgactaaaggatggagagcacggtaagtatcccacatactgtaatcttcatagtaatttctaccgttggctgattgtctgaacgggtgtcctgtggaaaaagaaggatagcgcccgtctacatcattgaatgtacgtggcaggaatgaggcacggtagagtgctccgtaaaatttctctttatcgtttcggttgtttgtctgtattgtaacttgtgaaagcctttgttcccagatggagttcagttcctgtcgggtgcggtcaaaatcccaatgaggtatctcggtgtccagattcttttgagcgccttccatgtcagtaaaagaggaagcggctttgattaatatgggtccttctgagtgtattttgaaccggagatatgcacctatacttgttccatcggctatctgtcgttgtccggcgaagagactgtcatgccggaatgtaccatattcttctatttcattttgatattcaatgataaagtacccgttgtatccggcgggttctccccagccttgatagatgcggtggacgggattgtatccgcgtatctgtttttttatggtatcgatttcaatatatcctttcccttcatcactgttaggattgactatgagataagcatcttccggttggttataagtgaatcggaaaatggctgaacgggaacgtccggtcatttctgcaaagatggaataatctttgagaaggacagagtaataggcgggcgttgctgtttcttcttggtgagagaacaggcttcctctgtcttggggaagatatttcagtgtacccgatacaggcatcaaggtcatggaaccgtaatcctgtgtacaacctccgacaatccaatgtgaattgcggaaaccttgtattttcgtatctttgtaataatagggagccttacattttgcttctgtatcttgtgtttggggagtccaaaagttcattccgttgggctctagaacagcaggcagcgtttgcccgtactcttcggtatttttgccgaaaagttctgcggtgtgggttgcgcttggtgcagtgcccgtacgggtatctacgtagaacagtagggattcttcctgatgaccgatacaagcagtaaacaggctgcatataatcagcaggtaagatagggtacttttcatagctcttcttggaaaagggttattttttaatctcctgatggagtatttttataaagagttccggccggtccagattgactaaatcgggatggacttcaatcgcttttttatattctttttcactcgcattctgaatagcagccattatcttgatatgattgcttttgcagaattctttgaattgaggagtgatattgaggatatctgtttctacataggccggggtgcatattttcatccatttctccaaagccgctatattggaggcatttactttaatcttcatttccggagcgattttgataaattctttcagcatttctgagtctgcaaaccagaagaaacttttattttcatatcctttttggcgtactaatgtaatcaaatcttttatcggagttcctcgttttacatcaaaaaaaatgtgtgcctttccttgtagggtatctagcatttcggctatacggggtacgtgaatgccgataaatcgagaactgaaccaactgccggcgtctaatttttcaatatctttggatagcatatcttgaatgggacctttaccgttggtagtacggtctaaagtttcatcatgcagattataaagtatattgtctttacttttgcgcacgtccacttctatccagccggctccatgtttcaatgcagctagagctgatggaatggtgttttccggcgctatatggttcgctcctctgtgtactacgatttcgatagagtcctggtacatcattttatgggcatgtataggaaatgggaataataccaagatggatgtcgcgatatgaagtaataagatttgatgacgtttcatgaattattttttgctttaaaggtttttataagagcttgccgtaacaagcccttataaaaacttatttaatttatcaataaccgtaattttgcttccagttggtgtttgaattcatcaagccgacagatacagggaagattctacgccatttctcggtcttggcttccggatgatattgatttttatatccccagtcgtcttcgaactttccaaaacggattaggtcattgcgacgccatgtttctgcgtaaaattcacgtgcacgctcttcaagcaactcgtccaatgaaggagaatgctccaataatggagcgttacagtagctgcgtatttggttgaacagggattgtggcgtatcaccgttcgtagctgttgctccccgtagaatagcttctgctttcattagcagaatatctgcataacggaagataggtacatcattgctttgattccggttatagaggttataatcgtctgcttgaatagcccatttgatgcatcggtatccctggcaccatgcgttcaagtcatttccaagatccatttggtcattcaagatggtgatattcttggtgaggacaacttgttgtccgttgtatatataaggttctgttcccattgtatgtgtgctgatgtcataatagttgatcgcacctttcatgatgatgtcattgcgttcatctccttccaggcaaaaacggtctgctgcttcaggagtgacgatgaaaacgcctccagcatttttggatagtgttataccgaacagtcctttgccgtccgcgccgtcattgttgaatttaggccagaattgaaaacgggcgtaagtattggctctggttgatgtttcattattttggtatggcattgcatagatgaaatctttgatctgatagccgttgtccggcatgaatttcttgcgataaccatcactgaggttgaaatgaccagaggcgatgatatcatcgcaatattttatgacatcattcaatttggaattagtcatgcttggatcataagtagctacatcatcacaggtataaacagcccagtttatatagagtttggcaaggagagcctcagccatccatttggttggcttgccataagtggaagcatcaacatcttcttttaaaccgccggaagccaaagcacgaagcaggtcgctttcgataaattttgtaatttcggaacggggagaacggtcgatagcttcagaatcgccgatcaaatggtctaatttgggagttgctccgaatgtatccataaaaataaaatgatagaaagcacgcatggcaagtgccggagcaatcaaggcttcttgttcggcattgttttcatcctctccacccaggtcaaaaattgcttgattgcactttgtgattgcagccggaatatcaccggcccagtccacgtgtgcgtctcctggaaggctggcatgaagagaggaatggatataattgccgccatcataccagttaccaccaaatgtcactgccatgaattcatcagaggacagcagggcagcttccatataacgacgtcctaatgctccgccgaatccataatacaaacctgccattttcgcttctttggcaatttcggaatccgggtattctgtataagtggatttaagatccacatctagatctgtgcaggaggagaaggtgaacagaccacctactagccaggttattaattttatgctatttttcatattagttttcaattatatggttagaaattcatgtttacaccgatcataaatgaacgggtacgcggatagtaattggtgcgtctgtccatacccggttccaagcctccaaggttgatttccggatcacgaccggagtaaccggtaatggtgaatacattattacaagtagcgtatagcttgagcgagtttatccagttaccaattttgccgaaagtatatcccaatgaaaccgaggacagacggaaataactaccgttctctatccagcgattggatggtgcttgagattgtgtgtctgtagcacggtgttcggtagctacgctttttaatacattgcggccttctttcacaaaagaaacattagagtattgttctgcagtggcgttgtagatatcttgtccaagaacaccagtaaagaataaatcgagattccagttcttgtattggaagttattgctccagcctaaatttaaatcaggttgtgcacagccggtaatagtacggtctctatcagtttcaggatctgtggtcgtttcgcctgtacgctcacccgtttcaggatcgtgtacataaaagatggatactccttggttattgtagccggcccattcgtaggtgtagaaggtgccgataggatgtccttccatgatgcgctgtacgtctgcatttgaagaataacctgcgatttcaggatcggctgcacggatataatctacggaatattcactgttggatatactttctacgttatttttattatgagataagttcaaactggtttgccaagagaaattttttgtttgtataggagtggcattaatggtaaattcaatacctttattgctgatatctcccacattggccggcatggttccgaaaggatagcggtttgtggaaacctcgtaagtgtatatcaggtcgctggtacgcttgtcatagtattcgatggttcctcctaatctgcctccaaagaagctgaagtccagcccgatgttcaacatggctgtacgttcccattttaggtctggattggcatttgaggcggctgccagggtatggtaactattctgtgtgccattggcgtttgtatagttgaaccaacctgaagtactgtaagtctggatagccgaataagctccgaatccgagtgagttaccactaacaccataaccaacacggaacttcaagtcatcgaaaacatttaaatctttgatgaacttttcttcgctcatacgccatgccaacgatgcagatggaaaagttccccaacggttgttctttccaaaagcagaggagccgtcacggcgaattgttgcttgaagcaggtatttgctgttgaaggagtagttgatacgtccataaaatgagatcatacgtaaagtttccaaatgaccgttattattgctggtgataccgccattctgccaatccattttattggcaaggttcagattataaaaggtggtgttatcattgtaaaagtcgtagacatccagaccgaaactgtcattgtcatcattctgttcccatgaataaccggccatcaggcccagtttgtggatattggcgaatgtatgatcatagtttatgtatgtttcaagaatttttttcttgttttctgttgcaatacgtttagcttcgccatttcgggtgttatattgggatttgctggtatggtattcgttccatatatattgttcgtcttgataggaaagacttaagttccatttcaagtccttagtgatatctaaagtacctttggctgttccttgaaggagtttcttgttattttcaaaagtatcttcattgatcatggatacaggattgaagttttgggagatagttttgtcgctataccaagaaccgtctgcattggtgacaggaactagtggagaataataattcatggcatcgaatacggattggccatctttggcggaatcaacggtggtaccttttgattgtgcggcattcacattaaaggctaaggtgagccgatcattcagtgctttggtttgcaagaatgcgcggccgccgaaacgctcgaaatctgtaccacgtacgataccttgtttgttttgataactcatgctggcactgtattgagtcttttctgaaccgccattgatagaaacgttgtggttatgactgattgctgtgcgcagtacttcatcgttccaattggtgtttgctcctttgtcattcggaagagtgatgttattttccttggcataggtgcggagttcgtcggcagtcatcatatctaaacgcttggcaatgttgtcaaatgcaagatatgcgctgtagtttacagaagtgtgctcacttttactaccttttttggtggtaatcaagattacaccgttagcagccttggagccataaatagccgttgcagaagcgtcacgaagtacgtcaatgctttcaatatcttcgggagcaatcagacttaatgacataccgggaataccgtcaataacataataaggttccattgccgcaccggtacgcagagaagaagccccacgtaaagagatagaagctgtaccagaagtcgggtcgctgctttgtactaccgtcaaaccaggaactttaccttgcaacaactgtccagggtcagaataaactcctacattcagtttgtctgctttcacagtggtaatggagctggttacatccttacgactcatactgccataacctactaccacaacttcatctaatgttttagaatcttcttccataataatcttcagagaagatccttttactgtaatttcctgggtagtgtaacccacgtaagagaatacgagtgtctttccttgtgctacattcagtgtaaactgtccgttaaagtcagtgataacaccgttggtagtacctttttcgactacattcactccgataaggggttctccggtcttgtctgtgacaataccgttaacttgattttgagcaaatgccagtgtactgtttaataggagtaatgcaaagactactatctgtgcaaatgtcctttgggttagagattgtacgtttagcatagaatttaattttggttttgattaatatgttcttgtttaatactgcatagttctctatatattatgaattggttgttacagtttgatgtatattttcttaagatatagcggataaccgatacaccccaaaaacagagtgaaaacgagggcgtagacagctgaggcaaggtaggcgtcggttattcctgaatgaatggctgcataggctgccgccttccatccggtacttcccatcataatggcaagtacttcgctcagtacatagaggaatagggggttgacgccgaagatgatgaagaagcggcaccatttttgtttattccttatgtctatataatacattaatgtggcaagtgacatggaagccgctccgcaggtcaccagaacaaaagtaggagaccatattcttttatttaaaggcagcgcatctgccaacaaatagccgatactcatcagaatgaatccggtcaagaacaaacggagcactttgttttctgtctgatggctttgtattatccattttccacatgaaaaaccgatacaagtgtgggcgatagcagagagagtgcttacaaatccttccggatcaatcgggctcttctgatagagatgtgcttcgccgaaaagttgcctgtcaatgatggataaaatattgctttcatcgcaggtataaccgttccccatgcataatatgacagtgtaacttaccagtaagataaaggttaatgtggggatgaacttatgattcataaatagggctgtaaaagaaataacacagtaacataaagcaatgcgttgtagtaccccggggatgcgcagatggacaaaaggcaggaagtcaccttcacatacatggtcaaaccaaccgattgcccatccgatgcatagaataagaaatgtgcgtttcaatatcttggttaccacttgtagggaaacgttgaaattgaatttgttcaatgaaatatatgttgaaatacccatgatgaacagaaagaaaggaaaaaccaagtcacaaggtgtcagtccgttccatgcagaatgttgtaaaggtgcatacgacactttgcctcctgcattgttgaccagaatcattcctgctacagtgatgcccctgagtgcatcgagtgacaaaagcctctttttaatgggcagtgcctgctgtgcggtttctgtatcgagttctttctttttcatcttacaatcaattgtttatcaatgttatagcctcttttgctacttctatacaatcaccttcggcagatgccgcataggtgttctttgccagtgtccatggttcttccagggcataccaatctatggtcatggctggattatcggcagtgggggttgatgaattacctactggcagtacaggaagtttgccatccagttggtcttgcagtacttgccagtatttttcccaacgtttataataaaagtcgcgcagtagtccgttccattctttatgggcataatctcgtaacttgccgatgtcggcgcagtaacggtttccccatgtggtgatttgtacgcgggcattccattcgtagaggtctttctcttcagatgtacttcctagattgcgcgcttgttgaatccagttccctactttgaattctttgcgtgtgcccaacagtttgtcttgcattatcagtagttccaagaactgtcgggtatgtgtggcataactttttttatcgaagcttttaaagtcggcaacagcgtaattgtacactattcgggcacggtcggcaatggcttgtcgggtgatatcaactagatcatattcaaagttgttgttaccgcgatatttgtgtgctacgctcaccatcaatcgtgcggcttctgctgtggtagtggggtcgtaatagttgcacattttgctccagctggatgcttggaaattattcagtgatgggcgcccgcaaaagatactttcgtgaggaccttgttggttgttgcctgccggacagttgtagataccgtttgccaggatctgccaagcttgccagatagattcatcgtctgtgccatagcgtgcgcggatgtattgttttatccattcttctttggtaaacttttctgcacgccaaggtagttcgcacatcagttcgaacataacgggattattttcaatgccttccattgtcagaccgatgccttttagctgagcggccagtgggttgtctttggtcaggtaaaaattatgaagaagttggtccatccttccatgcaaacccacgttcccaccgaaattttccaacaggcagaacaaccagttgtgttcttcgtatcctttgtctcgtttccatatagagggaatgccccacatgggacggcattcgctaaataaatcaaggatgagcagatcgccgggattcagcgctttcatcatttccgggcgtggattttctgtccatccctgcaccacccacacagcttttggattagcctttttcattgcatccataatagccttgccagctttgccgaagtctagtccggcaggcaagcttttggcttcatgaaaaggatcgatggagtagtagtcacttgttccatacagcttttcggtttcttcgtaaaaaaggctggcaatctgggtaaacttgggatcgtcgggcagtaagattcccggccggtcaaatccgttccatttgttgagagtgctttgggcggattccgaggagatgttgcttaatgttttctcttcttttccaccatcaatacgttttcccaaatccagtttggaggggatcatacccgagtaaccgggcagtacggggtgcattccccattctttcattcgtttcaatatctttttctgcaagtcttcttgctgtttataccaattatcggggttagggcctccccatccttccagattgttcatttcccaccaggcaaggaatgctggtccggcaataaaatcattgatttgctgtttggaaaatcctaagcggagtaataggttacgccacacacattcatgtcctacggcagcaagtggcaggttgatgccatgcagtgccatccaatccagttcctcttcccaacgtttccaatcccaaaatgccatggagtaggagtaggtgcagtaattgaaatcataacgcagggccagatttgtttcgtggcgttctttacggaagacgggaggaagaacattgggtagtgaggcatgcatactgttccatgacaggtggattccggcatgatactttaagtaccagttgattccggttgctatattaatataggtattgcctcgtatcactaccttgtcgcctttttggtccaactcgaaaaagtcatttgagcttttgtgtagttcgactacgaacttgtccgatgctcccttgtctatcctttccagcatttccttgatggggtttgccagtataccggaggggagtaatatcagccagctcaataataagaatgtgtttttcatatacatttgcatttctgttttttacaaatgtaagggaaacaaagctttttataggagaatatggtgcacaaatggagtaaaatagtaaagtgaactatttttttccaaaatattcgcttggaagtactccaaacagctctttgaagcattttgtgaaatatttagggtcgttaaaacctacggcatatgcgatttctgcaacagaaatgtcacattctactttggttaaagtgtcttttgccacatttaatcggtagtttctcatgaattgaccaatggattgccctgtcaaagattgtaatttctgattgactaaggttttgctgtatcccatatcgcggataaagcgctctaagttataatccgagtcggcataatgttctttcattaaattgattgccgatgtcataaatgtgttgtctttggaactagcgtttatattcaatgtttcacaattcatactagtggagaacatggatttgtatttctggcgtaaggcaagtatatttcggatacgtaatcttagaataacctcatcaaatggtttgcacagatattcatctactcctatttcatagctgattctttcttgggcttcagaccggagggcagtgagcatgagaaaggggatgtgggaagtagccagattagcttttacccggcgggataattcattcccgtccatgacgggcatcatcaggtcgctgacaatcaaatcaatcgtttctctttgaatcaagtaaagagcttctgcaccgttctgtgcttcttttaattgataattgtttttgagaatggaacaaatataagtacgcatatctgcattatcttcaacaatgaggatggtttcctttttctcgtttccattggcaggaatggaaagtggatgttcattctgctcatatttttctttttctgatttggcttgggggatacctttttccaaaggtaatagtattctgaagaaagctccttgcttgggattgtttcctgcatagatgttgcctccgtgcagagaaatgattttcttacataagaatagtccgattcctgtgctgctttgtccataaacgggatatttgatgctctttttggattggtagaagcgttcgaaaatacgttctatatcttcgggtacgataccattacctgtatcttttatatctatgaacagccaggtatggttgtttttgtcggtaagggaagccacatacaaacttatttttccataatcgggagtgaatttaacagcattggatatcagattaataatggctttgcgcatatattcaacatcaaatatccaaaacggggtacagagccggaagtaggtgatgatgtttatgttccgttcatgggcaaatacttcgaaaggcattaatatattttgtataaggcggataaagttttcgtttgtcttatttaatacaactttgtctgcatctaactttctgaagtccattaattcattgactagtgatagcagataattggaattccgttcagctatttgtagctgtttctttacttccggctcatggctttcgtcaagggcgcgttggatgggaccgttgattaaagtgactggtgtccggaattcatgagtgatattggtgaagaaagcaattttttcttccgttacctcctcgacgtgtcgtgccattatttctagttgtttattttgtaactctagctcatgggtgcgttgggctacttctttttccagttgttttttctgttgacggtacagacttattttccattgataaaaataatagctgcctacggtgatcagaatggcaagcaataaatagaaccaccaggatttatagaaataaggagtgatggttactttgacttccgttattttatcggaccaatgtcctttctcgtctgtggcacggacttggaacacatattttccggagggaacgaaattgtatctagcagtatgttcgccaggaagggtttctgtccattcattctcataatttttcaagcggtaggcatatttcactcggttacagtttccatagtttaaggtggaaaactcgatggaaaaaccatgatctttttcgtgcagacggatggtatgtaaatttgttaccgcgcagggagtttttccgtctgctggaggatagaccatggtaccggcgacactgattgaggtcagtttgactttggcatcctgcttttttgtcttggctatatcgggggtgaaagcgactaatccgtttatagtaccgaaatataacaggttattttggggagaataataagatgcgttccaataaaactgattattgggcagtccgtcttcttttgtataattggtgaaagtcatggtttgtgtatccagttgggcgatgccgtggttggtggacatccacagatgtcccgttttatcttccacaatacctataatggtattattgggtaacccgtccttgcgggtgtagttatgaaatgtgaactgtgttccgttttcttccgctagttgatatagtccgttcccatttgcccccagccagatggtaccattatgatcttctatgatacagtttattttttctaattgcaatgaagtgggttccgtcagtttatgttttaaataggtatagctgaattgtgcggaggaaatggagaacgagtgtaaatccataatgaaaactccttcagatgttcccatccaaaggcgtttcttgcggtcgataatgatggaccctaccgcatcgaattcattgtcggaacggtcaaacaagacccgggtgaaacgcttggtctttttatggtagaaatgaagccctctggtagtaccaaaccataaaccattgttcatggtgtcttcacaggcgctgctcaggaaatctccttccagtcctatggagtcttcccggatatggcgttggaaagtttggttatgggggatgttcagatttagttcattgattccgactccccaagtatatgcccataaatgattttcggaatcaatgagaatgccacggatagagttgttactgatggaagtgggattgttctggtcaaaagtataatgaatgaactcatcgctgcctttgctctttttgttgagtcctccctctactgttcctacccatagatttccgtctttgtcttcgctgatggcattgaccggattgggggaaagagaggtttctcgaagatagttatattgccacacatacgtttgcagacaattgggagtcaataaattgattcctcctatctcggtccctacccagatattctcattgtcggtcagcaggcagttgatgaaattacagttcaacgacttgtcaggcatttcattgttttggcggatataagtaaaagtatcggtatctcgattgtatacattgagtccgttcagagtagaaacgatgacatctcctttgctagtcagtttaactccggttatataggcttgacttagcattccggggcgatgattggagtaacggtaccgtttcaaactctgccgggtatggttatacttgaagagtccgcgattggttcctatccataacaattccccgtcagtttccatgcagagaattctccagtcttctgaaaagggtttcagcagctccgataccatgctggttttcagtaagtggttgcttcctttttcaatacggcatacatgattatctatgcctgcacagatgtattcttgcaggtcaataacagcgtggatgggggattctgtatcttttttcagtttatagtaatcttttatttgcccgtttacgcctagttccagataccatagattcttgtctgtcgatatccacagattgtcctgcttgtcccgatagatggatgcaatgtagttacttgctagagatttcaattcggcaggcagttctttgtccgtgtctatctgtgtataatgtttcaagtcaatgaggtctattccttcttccgaccctatccagagtcgttgaaacttatcctcacagactttatgcacgtagtcgtttttcaagcgaatggagtgggattgggaattataatgaatgaattgatagccattataccgtcctattccattattagtagctacccagatatatccttgagtgtctttgtaaatatcattgatgaagttatggggtaacccagtatcttctgtaatgaagctgaaattatatcggttgaaaaagttatgtaagttttctccaaataagttcaatactcctcctgtaagtagaagaagtgctataatgtgcgttttcatattagtaattgtttcccaacaaatgtaaataatagtaagatagttccaaaacatttgagtggaaatcttgtatctgagagtaatataaggaaaatggcggctggagattacaatggaattacaaaagaatgtgatgaaggcttttatgatatgtatgataacaaaaaaggctcgctatctgcgaacctttgtgctcttcgtcttggacttgaaccaaggaccctctgattaacagtcagatgctctaaccgactgagctaacgaagaaaatttgcatttgactttaaaagtgctcttcgtcttggacttgaaccaaggaccctctgattaacagtcagatgctctaaccgactgagctaacgaagaaggtttttctctcaaatgcggtgcaaagataataggtttttccgaaatatgcaatatctttgcagaaaaattttagataaatggataaaataattggaatgggcaatgcattggttgacgttcttgttactttgcaagatgattcgctactagatgagatgagtttgcccaaaggaagcatgcaacttataaatgaagataagtttttgaaaatcagtggtaaatactctggtatgcaaacgcataaagctacagggggaagtgcgggaaatacagttttggcgttagctaacctaggggcacacccgggatttatcggaaagataggaaacgatgattttgggcaatattttaaaaaaaacggtttgaagcagggaattgacatgaaattgctcgccggtgatttgcctacaggagtggcttctactttcatttcaccggatggggaacgtacttttggaacttatctgggagctgctgctactatgaaagccgaaaatctgacgttggatatgtttaaggggtatgcatatctatatatagaaggatacttggtacaggatcatgaattgattcttcgtgctatgcaattaggaaaagaggctggattgcaaatctgcttggatatggccagttataatattgtggaaggggatttggaattcttcgatattttgataactaaatacgtggatattgtttttgctaatgaggaagaggcaaaggcttatacaggcaaggatgcatggggggctatcaatgaaattgcttctaaatgcagtgttgtaatagtaaaactaggtgcccaaggttcatgtataaagaaaggtacggaatgcatcaaactagaggtacctccggtaaaaaaagtcgtggataccactggcgcgggagattattatgcagcaggttttctgtatggactgacttgtggttattctttggagaagtgttccattataggttctattttagcatccaatgtgatacaagtggtgggtacaaccttatcaaagaaaaaatgggacgaaataaagttaaatatagaggcccttctacaggcttgaatagaataatgtattaatttgcggttcacaaatacataaagtgatgaagtggaatagtaagaaaatattgttaatgatttgcgtgggcctgacaggtagcgctttgtttagttttaataaaggtgatgaccgtaatttccagatagcaaaaaacttggatatcttcaatgcgatattcaaggaattggatatgttttatgttgatactattgatcctgagaaagtgataaaatatggtattgatgctatgttggcgcagaccgacccttacacggagtattatcctgaagaagataatacactaaaggaaatgactagcggaaagtttggcggtatcggatcggtaatacgttattatactccccgaaagcgtgtggctattattgaaccttccgaaggaagccctgctgccgaaataggactgaaagccggtgacatcatcatggagatcaatggaaaagatatggcccagggagatagaattcccaatgatctgacctcgtatgtcagtgataatttgcgtggtgagccgggaacaacttgtgtgttgaaagttgagagacctacttctgatagtacttatgtgccaatggaatttaaaataacccgttctaccatccgtacgaaccctgtaccttattatggaatcgtaggcaataatgtgggatatatcgttatcagtacttttgctatagagaactgttcaaaagatataaagaaggcattgatagaattgaaacagcaaggtgctaaatctattgttctcgatttgcgtggcaatggtggcggtttgttgggggaagcagtgaatgtagtgaatttctttgtgccgaaagggaaagagattgtggtaacaaaaggtaagattaaacaagctggtaccacttataaaacaatgaatgaaccggtagatacagagattccgctggctgtgctagtggacggttctacagcttcggcatccgagattgtttcaggttccttgcaggaccttgatcgggctattgtggtaggaagccgtacgtatggtaaagggttggtacaggtacctcgtgaattgccttataacagtagcatgaaagtgactactgcaaagtattatattcccagcggacgatgcattcaagccattgattacgctaaacgtaatgctgacgggtcggtggctcgtactccggacagcctgaccaatgtattccatacagcagccggacgtgaagtgcgtgatggtggcggtattcgtccggatgtggaggtgaaagttgaaaatttcccaaacattatgttttatctgcttaatgatgatatgatttttgattatgctacccaatattgtatcaagcattctcaggtaggggaagtgaaagactttacaataacagatgctgactatgttgattttaagaagatgttacataagcgtaagtttacttatgaccgtcaaagtgagaagatgctgaagaacttgaaagaaatagcggagtttgaaggatatatggatggggcaaaagaggagtttgccgctttggaaacgaaattgacgcataatttggatcatgagctggacaggttctcgaaagagataaaagatgctattgctcaggagattttgaaacgttattatttccaacgtggcgcgatattgcaacgcttgaaagatgatcctgatttgaaaaaagctattgagacattgaacaatcagtctgaatatagtaagatactttctgttatgaaataatcgaatgaggggcggatgtacgaatctgcccctcattattgtatcatgataccattgatgatgctttatttgaaccgggaagtatctattggtttatgctgtttttctttataccctccgaacttgtaggtaaaggataaagttatgttgcgtgaatagttgttggtgtgcatgtccatgtattgtcctttattacgtagtgtcacatctatgttgccttccatcgaattgaacagatcattggccttcacttggatacttgctttttggttggcaaagttccaacgtattccggtatggatggcccagatatgatttaaatcataacttccctggatagatgggctcaaataaagtccggtcagttccatgcgaatatccggtttggtagaaagtattatattattttgtaacatggcgagtccgatccacttgctgtggttgaaggaaagatcgaagaatttgttacattttgcttgacggtattcagcttgcagtgtgacgtgactgtccaaccaatgtccgattttgaagggaatgatagtcgtggctgagaaactttgctgataatcccagtttaaggttttgtaaatcaaagccaggcgttctgtgctttgataggctagttgctgaaataaatcgggttgataatcataagccaggctgaagatatacttgttctttaaaatataattcagatttgcggaataatcggtggatggctttaacattggattgccttgtacttcttcataaccacttatatagccggtactttcgctcagatcccagtagctgggataggacttatctgatgtgaatgaaagttgtagaatatgtgctggggtcattacgtatgttaattcagttgtaggataagccgcccatgcatgataacgggccgttttgtaatattctccggttatggacgcgctgaaagacaaatgttctcccatgtttttgctgaatccgacgtagaagtcatatgtatattcattataacgattgtttgtattgagttcgctcatgtctgttccgttttgggtatgatagaactgagtattatggtcactggcataagttaaagaggtgccatagtttaaggtccactctcgtggtagtgtgtgtgactggtctacgtatattttccagcggtctattgtttgtccgctagtcgtgtgaaattcgcttgtttggttcttgttgtctttgttggtgaattgctgatgactttcggaatggtaggaggtatagtttattccagctttcataccgaagctagagagataatctaaagcgatattgtgcattcgagtctccttttttgtccggttgtctgcggttgtgatgttcccgtcggaatatgaatgattatcgttgttagggttgaagacaccagtataggctagattgatatgagcattatcattgaatttatattcagcgcctgttcgtacataatgtgttattcctttcctgtcaatatcattgtgttgacagatatcatatatattattttttaaggtgtgatgtgagtacgtatctgttgtttgtctgttttgttcataatgggtattatatagcaagtctatattccatttaggagtggtgtaaagcaggctgattcctccttgtgtgccacttctgtaattgtatagatatccggcgttaacttctccttgcaacccactttcttcaggacggtaacctttcaaaagtaagttgatggcagcacctcttacatgatattgcggcggtgtgctatacataatttctgccttttctacacgtgaagccggagtgttttttaataaaatggtcaactgttcgtgactcattgttgtgggccttccgtttaaaataatgttcagattgtgtgtgcctgctaatgaaaggttgccgtttatttcctgtacaccgggtaattgctgaaggatttcataagcattgttcacgattctatgtgtggtgagttgtgacagatcatacgataattttccttcttccacttttacaagagggcgttcccctttgacgataacttcgtccaaagcataatctttacttttcagggtaatcgtgcctgcgtcttctcctgtagttgtcaataagagggtttcgtacatgatgtgttggaaaatcagccgataagatgctggttgccggttgaacctgaagtaaccggtggtatctgtgattacggcgtccacaaaagtagaatcaatggtttgtaggatgacggttgcaccgtcaatggcttgtgcatggatgtttgtaacctttccggtaatggtttgtgcagtggttgttcctataacccaaaataaaaatagcgatgtgatgataaaattttgctttttcatatctatttgtttttaatattttctttaactttgacgaaacaaaagtagggagacttttttccttacgtggttaatggcaggttaacacaatgttaacaaagtatggataggatataagtgtatgacaatcaaacatattcgttgggtagcttgtatcggactgttggcaatcatctgtttgcagtacgtttggcttgtaaatacctataagctaactaaggaaagtatacagttcagaagcaatgaagtatttagagatgcaacgatgcgtgaggtgttttatcgcatggaagtatatcaagattctttgcaaaagaagtataaggacaaagatacttccattatggttagaataaatctggatgaagattatgatttttttgaggatggcagaggggataaaaatgtgaaccaatggttgatgtccaatatgcaggtttccatgcaagaaattgtcaagagggattataaattgtctgtttctttgtcaagtttagattctatttatcggacaggccttgctgccgaaggattggatgcagaagtaataacttgtgtgacagattcgctggggaatattcttagaagttcccgttccatacaggtaggggattatggcttgttgaaaaccggattacaacctatcaattataaatgtacggagaatcttcaggcttttattgttaatccttattgggttattttccagcagatgaccttgctcctcattgctactgtcttgatgatggcaatgatcgtctattgtcttgtttatcagattcgtattattgctcatcagaataaaatagctaggatgcgtgaggatttctcatacgccatgattcatgagatgaagactcctcttgcctgtattttgatggggacccgaatgttgaaatcaggaaagttagatatttttccggataaacgcgagaagcattttcagatattggaagacgagagtgaacatttattgtcactgactaacaaagtgctgacgctgtcaaaattggaaaatgctcaattgaggctttggaaaaaggagatacaactccgtccgatgttagaggatcttattgagaaatatactgctaaggcagataaaccagtacatttctctcttcatttggaatcggaatgggtatatgctgatgaagaattcttgaaagaagctatcggtaatttggtagacaattctataaaatattcaggtgaagaggtggacatacagatttcatccttgcgtcaggactataacttttatttgataaaggtaagagataacggcataggtattccgttgaaggaccagagtcgtattttcgagaagtacgagcgtgcttcggctgccgaccgcagccgtaaaggcggtgcgtcaggcttcggattgggtttgaattatgtttttcgcgtggctgaagcgcatggtggaaaagtgtgtgtggaaagcattgaaggggagtatagtgaattttttctttttttgccgagtggggagaagaaataaatattttttaaggaggaagatgatatgataaaactgttgttggtggaagatgatgccaatctttgttatattattcgtggtggattggaggatatgataggtggatacgaggtgatgaccgcttctaatggcgaagaagggctgaagatatggaaggagcaacatcttgatatcattatttcagacattgagatgcctgttatggatggttatgaaatggtacgtcgtattcgggaaacggatggatttattcccattgtttttacctcgggcagggtttcgcctaaagatgtggtgaaaggttatgaattgggggtgaataattatattaagaaaccttttttggccgaagaactggatgcgcatattggtgctttgttgaaaatgaagcggggaatgggagccgctaatgaaagtgagatttatcggattggtgaaaattatacatttgatgctgttcatgcagtattaaagcattcgtcgtgtgtacaaaagacaatgacggaacgcgaagcgaaattgcttcagatgctttgtaaaaagaaaaatgaactagtgaggcgggatattattctttcaagactatgggatacggaggatgatttttttgcatcacgtagtctcgatgtttttgttactcgacttagaaaattgtttgctgatgatgaacggatacagataaagactgtgaaaggagtgggtttatgtctttcggacaaaggatgaatatgtgtaatataacatttattgtaagttcttttggcattttccagatactaaacgtttttaagcaactcgaaaagatgtgcattggtgaaatgaccgttcttgaaaatggattttgtcattattccgactttgttgaagccggccttttctaatactcgcatggaaggaaggttgtgttcaaagacaagtgcgaatatacgtattgtattcgtataagtgaagtaatggtagatggcttcttgtaatgcgtcggttacaataccttggttccaatatttttctccgataacataccctacttcagcattgaagcattccacatctgtgcctggtgtaaatccgatattgcctacggcttttccattaacttcaatacaaaaatcatgaatgccttcttttttctggatgaggtcaataaaggtttccgcatgctctagcctgtaagggtgggggaatacgttgcggcaattgtcccaaatctttttgttattcagttcttgaactaatgaatgagcgtcttctgtttgccaagtacgtagtgtgtacttgttcttttgtacaaatacagcatgatagcgtctcatgggggtactgcagagcccatggtaattttgtttttctcctacgacagcaaatcccaaactctggtagaaaggaatagcataagtagaagaattaaccgttgtttcaatggaaggatggagggtggaggcgtagtggaaaagtttttttcctaatccgtgcctgtgatattctggcttgataaaaaatagggagatatgtttaccattactttttatacctaaaatgcctgttagagcttcattgtcaaaactaccataaaatatgatttcgtttatacattttttgttataaataaagcttttgaaaaattccaatccctcattgttgaaatcttctttgccggtgatggtgaaaacttgccaagatagttcgatggcttttgggtattcatcttttgtgagttgtcgtatgttattcatggtatgccatattgtagattagtgtaaaaataggtagagcaggtatgttctttgtaaggtggagaaggataaaggtgcatttaaaaacaactttatccttctttgtctattaactagaaattataggctacgccaagattgaatacggcttggtctaggtcgctgattaattggtatttaatatcaaagtttaaactccagtttttgtctaagtcaaactccatacctgctcctaaattaactccaaattttccatcacttccactgacatcgtaatcgcctgctttccctaaatccaaatgccagttagtgtatgtaaatcctgctaatggatatagactaatattgcttgctatgggaaaaaggtagtggatatttgcgttgatgtcaaacatgctaagtccatcatttttaaagaagtaattcatagacggctctattctgatttgatcagtaatattatattgatatttcagaccaataccaacgctctctatttcagttccataacttagatttccaccaatagcttgtttcccttgttgtgcaaaaacagaaccacaacctaaaagtgccatgcatgcggcaataataatttttttcataatcactcattttaaatgaatactaacttttctttatatgtagaattatttttcttcctccttaaaccaggaagcatacattaaatatccattggctattttctgattgagttctttgctttgtgcctcgggaatctttttgataaatttggctggaactcctgcccataggcttccaggttcgatgacggtgttactgagtaccagcgctccggcagctacaatagctccttcacctacgaccgcatggtctagtatggtagagcccattccaattagagcgccgtcttttatagtcgcaccatgtatggttacattatgtcctacagaaacatcattcccgatttcgacaactgatttttgatataatgtatgtactacactgccgtcctggatatttacgcggttacctatgcggatagcattaacatcgccgcgtaatacggcgttaaaccaaatgctgcaatcttttccaattacaacatcgccaataatagtggcattatcggctaaataacagttctcgccgatttttggagtgaatcctctcactgattttataagtgccataattaatttctaccgttttaaaggagatgttacttcttttaaccactcgcgttcctcgttgttcaattccggattcaaacaattgtaaactttttcatgatattggttgaaccatgttatttcttcatcgctcagcatatctgtcaggatggcttctttgtcaatagggcagagggtaagtggctcgaatttatagtaagtgccgaattctgtctcttgtgacggaacaattaacatggtattttccgtacgtactccatggcgtccggttttatatataccgggctcgttggttactgtcatgcctggaacaagtaaggccggcatgtggttcatgcggaattggtgaggaccttcgtgtacattcagaaaacaacctacaccgtggcctgttccatgcaggtaattgattccggctttccacatagggaggcgagccagcgcatctagttgtgttccgcaagttccatgtggaaattgagccattgagagttggataaatccttttaagactaatgtgtaatctgttttttcttctttcgtgagtgctcctaaaacgatagtacgagtaatatcagttgttccgtccaaatattgtgctccactgtccagcagcagcatgccttcaggttttaagggaatatcggtttcgggggttgcttcatagtgaacaatagcgccatgagctttatatccggcaatggtgtcaaaactgataccattgaagtggggttgtccggcgcggaattcgtataatttcttatctatacttatttcggtttcatttccagtagaaacagctgctttcagccagcggagaaatttaaccatggctactccgtcgcgtttcattgcgcgatggaagccttctatttctgtctcattctttatcgcttttaaaaaaagtacaggcgaaggagctatttctattaaggaatgggcgcaggctgctgcatggacagcggcattgatattagctgacaacaggagcttgccggtaaaatcttttaaatctttttcaattgttgaataaggccttactttaatttcgttttctgttagatagtcttttacttcatctgacagtttattctctattatatataaggtagaactatattccgtgatgagaaggtaacttacaaataccggattgcagtgtacgtcacttccccgtaagtttagggtccatgccacttcatccagtgcggaaattaaaatgcctgtgcaactgttacgacggattgcttctcgtatttgagtgattttatccttgtaactgagaccggcatatttcaattcatgtataaacactttgttatcgggcaatgcaggccgatctgtccataattcattgaatggatcgggagcaagggttaagtgtatctgttttttttctaattctttctgtaagttgcttgtttcttgatagctgttcacccagccgtctatacccacattgtcttctgcattcaatacacagcccaaccactctacaatggaaggagtttccggtaatcgttccttgaataaagtaatacctgtgttttccaattgttcggccgcttgaagaaaatagcgtgaatctgtccaaagtccggctttatccagtgttacgacaaccgtacctgccgaacctgtgaaacctgatatccatttacgtgcttcccaatgtttggggatatactctcccgaatggggatccgtactgggaataataaaggctgaaagcttgtgtttacgcatgaaattgcgcagactagctattctatttataatttccgatttcattttaataggtttataatggtttgtactagaaagcaaagatacgatttctagattattttaaataaataattgcggaaagttttgtaaataaagaaagtatgtgtaattttgcgccgcaatttgactatcggaaaatattaataacaacatatttaataattaaaaacaatgattgtagtaccagtaaaagaaggcgaaaacattgaaaaagcgctgaagaagttcaaaagaaaatttgagaaaacaggtgttgtaaaagaactaagagctagacagcagttcgacaagccgtctgtattgaacaggctgaaaagagaacgtgctatctatgttcagaaacttcagcaagtagaagaataattaaaaactcgcacattctttgaataattgaattctttttcatatattcgttgctgaattgataagcgacgtttcttatgatgacagactcttttttggattatcttcgatttgaaaaaaactattctgaaaaaacaatagttagttatggaatagatttgaccaagttcgaagaatacttcaaggggaaagacgagaaagtcgattttacaacggtagatgctgatttggttcgtggttgggtgatgaacctgatggagaatggatatacatctgcttctgtaaaccgaaaactgagttcactccggtcgttttatcgtttccttctaaagaaaggtgtgatagaggaggatccgatgttgaaaatcattggaccgaaaaataagaaacctcttcctgtatttctgaaagaacgtgaaatggaccgactcttggatgatgttccttttaaggaggattttacaggttgtcgggatagaatggtgttggaaatgttttatgctacaggcatgcggctttccgagttgatagggctgaatgatgtggatgtcgatttttctgcgtttctgataaaagtaacgggaaagagaaataaacagcgtttaattccttttggagaagaattgcgaagggcgatgtctgtttatctgaaaataagaaatgaagtgttgcctggaaaggcagaggcgtttttcgttctaaaaaacggaaaacggatgtatcctggaaaggtgtatcttttagtgaaacggaacctgtcaaaagtggtgtcgttaaaaaaaagaagtccgcatgtgttgagacatacttttgcaactgctatgttgaataatgaggcagagttgggcgcagtgaaggaattactgggccatagtagtctgactacaacggaaatttatacgcatacgacttttgaggaacttaaaaaagtttatgaacaagctcatccaagagcgtaaaaaaggaggtatttatggaagttagaattcaagccattcatttcgatgcaacagaaaaacttcaggattttattcagaagaaaactgctaagttagaaaagtattgtgacgatataaataaagtggaggtgtcattaaaagttgtaaagcctgaaactgcgatgaataaggaggctagtataaaagtgctggtgcctaatggtgaattttttgcagaaaaggtgagtgatacatttgaagagtcggttgatgtatgcgtagatgcgctttctaagcaattgacaaaatataaagaaaaactacgcggtaaataaaaaaaaacaccgaaagtttttgagatttaaaataaatatctaactttgcagccgcttaaccattcaaggcggaatggttgcgaagttagatatgacaagcctctttagctcagttggccagagcacgtgatttgtaatctcggggtcgttggttcgaatccgacaagaggctcaagaaaagatgctgagaagctgttgttctttgaaagtaagttgggcaaataccagagtggccaaatggggcagactgtaaatctgctgtctttcgacttcggtggttcgaatccatctttgcccacattcttaagacttgaaaggtctttggttttttgcggaagtagctcagttgatagagcattagccttccaagctgagggtcgcgggtttgagccccgtcttccgctcttttttttcttgctgttatagctcagtggtagagcacttccttggtaaggaagaggtcacgagttcaagtctcgttaacagctctttgataacgtaattgctgattattaatcaaataaataacaagtaaagctatggctaaagagaaatttgaacgttcgaaaccgcacgttaacattggtactatcggtcacgttgaccacggtaaaaccactttgactgctgctatcactactgtgttggctaaaaaaggtctttcagaattgcgttctttcgattctatcgacaacgctcctgaagaaaaagaaagaggtattactatcaatacttctcacgtagaatatcaaactgcaaatcgtcactatgctcacgttgactgtccgggtcacgccgactatgtaaaaaacatggttacaggtgctgctcagatggatggcgcaattattgtttgtgctgcaactgatggtccgatgcctcagactcgtgaacacatcctgttggctcgtcaggtaaacgtacctcgtttggttgttttcttgaacaagtgtgatatggttgatgatgaagaaatgttggaattggtagaaatggaaatgcgtgaattgctttcattctatgatttcgatggcgataatactcctattattcgtggttctgcattaggtgctttgaatggtgttcctcaatgggaagataaagtaatggagttgatggatgcagttgatacttggattccattgcctccgcgtgatattgataaacctttcttgatgcctgttgaagacgtgttctctatcactggtcgtggtactgttgctacaggtcgtatcgaagctggtattatccatgtaggtgacgaagttgaaattcttggtttgggtgaagataagaaatcagttgttactggcgttgaaatgttccgtaaattattggatcaaggtgaagctggtgataatgttggtttgttgttgcgtggtatcgacaaaaacgaaatcaaacgtggtatgattttgtgtaagccgggtcaggttaaggctcactctaagttcaaagctgaggtttatatcttgaagaaagaagaaggtggtcgtcatactccgttccataacaagtatcgtcctcagttctacttgcgtactatggactgtacaggtgaaatcactttgccggaaggaactgaaatggtaatgcctggtgataacgtaactattacagttgagttgatctacccggttgcattgaatgtaggtttgcgttttgctattcgtgaaggtggacgtactgtaggtgcaggtcagattacagaactccttgactaatcactagataattaatatgatcagttctcggtcgtaagacaccgggaactgatttttacgggagtagctcagttggtagagcaccggtctccaaaaccgggtgtcgggagttcgagcctctcctcccgtgctaaacttgaaagaatatgtttcagaaagtagcaaattattgtaaagaatcttatgacgaattagtccataaagtatcatggcctactcgtaaagaactttctagtagcgcagtggttgttttatatgcttccctactcattgcgctagttgtttttcttatggattcagccttccagtttgtaatggaggatattatctatccgcactaattaattgaataaaatgtctgagattgaaaaaaagtggtacgtattacgtgctgttagtggaaaagaaagcaaggttaaggagtatcttgatgctgacattaagaacagtgatcttagcgagtatgtgtctcaggtgttgattcctaccgagaaagtgtatcaggttcgcaatggtaagaaaattgtgaaagaaagaagttatcttcccggatacgttttagtcgaggccgctttggtcggtgaggttgctcatcatttgagaaacactccgaatgtaatcggtttcttgggaggttccgaaaatccggttcctttgagacaatcggaagtgaatcgtatacttggtacggtggatgaacttcaggaaggtggtgaggaacttaatgtaccttataccgtaggagaaacagtgaaagttaccgttggaccgttcagtggcttcagtggtctcattgaagaggtgaataccgaaaaacggaagttgaaggttatggttaagatcttcggacgtaaaactccgctggaacttggctttatggatgtcgagaaagaataatgcattctgttacgtgcattggactttcgctataattaatatataaaaattagaaacaaaatggctaaagaagttgctggactaatcaaattacagattaaaggaggcgctgcaaatccatcacctcccgttggacctgctttgggttctaagggtattaatatcatggaattttgcaagcaattcaatgccagaacccaggacaaagcaggtaagattttacctgtaatcattacctactacgcagataagtcttttgattttgttatcaagactcctcccgtagctattcaattgcttgaattggctaagattaagagtggttctgctgagcctaaccgtaagaaggttgccgaaattacttgggaacaagttcgtacgattgctcaggacaaaatggttgacttgaactgcttcactatcgagtctgctatgactatggtagctggtacagctagaagtatgggtatcgctgtaaaaggggaattcccgggtaataactaataaacttcaattataatgggtaaactgacaaaaaatcaaaagttggctgcagaaaaaattgaagcagggaaagcatactcactgaaagaagctgcacagttagttaaagatattactttttctaagtttgatgcttcattagatattgacgtacgtttaggtgtagaccctcgtaaagctaaccagatggttcgtggtgtagtttcattgcctcacggaacaggtaagcaagtgcgtgttttggttctgtgtacacctgatgctgaagctgctgcaaaagaagctggtgctgactatgttggtcttgatgaatatattgaaaagatcaaaggtggatggactgatattgatgtaatcattacaatgccgtctatcatgggtaagatcggtgctttgggtcgtgttcttggtcctcgtggattaatgccgaatccgaagagtggtactgtaactatggatgtagctaaggctgttaaggaagttaagcaaggtaagattgactttaaggttgataagagcggtatcgttcatacttcaattggcaaggtttctttcactgcagatcagattcgtgataatgcgaaagaatttatcgctactatcattaaattgaaaccaagttcagctaagggtacttatattaagagtatttatctttcaagtactatgagtaagggtatcaagattgatcccaaaactgtagaagaaaactaacaataaggaggaatcatgagaaaggaagataaaggcgttattattggtcagttggctgaaaccgttaagcaatacggacatttctatttggttgacacaactgctatggatgcagctaagacaagtgaactgagaagaaaatgtttcaaagcaggtattaagctggttgttgtgaagaattctttgcttcacaaagctctgatgagcatggaaggtgttgatttctctccgttgttcgattctttaaaaggtacaacttcagtaatgtttagcgaagtagctaacgctcctgcaaagttgttgaaagaatacaaagaggaaattcctgcattgaaagcagcttatgctgaagaaggtttctatgtaggtgctaatcaactggatgctctttgcaacattaagagtaagaatgaagttattgctgatattattgcattgctgcaatcaccggcgaaaaatgttatttctgctcttcaatcaggtggtaacaccattcatggagttcttaagactctgggcgaacgtgccgaataatcaattttataatcaattagtaacaaacaattaaaatcatacaaaaatggcagatttgaaagcttttgcagaacaattagttaacttgacagtaaaagaagttaatgaacttgcaactatccttaaagaagaatacggtattgaacctgctgctgcagctgtagctgttgctgctggtcctgctgctggtgcagctgctgctgaagaaaaaacatcttttgatgtagttttgaagagcgctggtgctgcaaaattgcaggttgttaaagccgttaaagaagcatgtggtcttggcttgaaagaagctaaagacatggtagacggtgctcctagcacagtaaaagaaggcttggctaaagacgaagctgaatcactgaagaaaactttggaagaagctggagctgaagttgagcttaaataatattagcctgagtatcaggtaatacggttaggaatcctctggtagaggattcttaacctttttgtgtctatattattattaagttctacaaaatattaacaaatgtcttcaaatactgaaaatcaaagagttaattttgcttccatcaagaatccgatgaagtatccggatttcttggaagtgcaattgaagtcattccaagactttttacagttggataccccgcccgaaaagcgtaagaatgacgggctgtataaggtattcgctgaaaacttccctattgctgacactcgtaataactttgtccttgaattcttggactattacattgatccgcctcactattcaatagacgagtgtttggagcgcgggctcacatacagcgtgcctttgaaagcaaaactgaagttgtattgtactgatcctgatcatgaagatttcgatacggttattcaggatgtttatctgggtcctattccgtatatgactccgaaaggaacttttgttattaatggtgctgagcgtgtagttgtttctcagttgcaccgttctccgggcgtgttctttggtcagagcgtgcatgctaacggtactaaattgtactctgcccgtattattccattcaaaggttcatggatcgaattcgctacagatattaacaatgtaatgtatgcgtatatcgaccgtaaaaagaaattgcctgttactactctgttaagagctgtaggttttgaaaatgataaagatatcctcgaaatcttcaatttggctgaagacgttaaggttaataagactaacttgaagaaagtcgtaggaagaaaactcgctgctcgtgttttaaaaacatggacagaagatttcgtagatgaagacacaggtgaagttgtttctattgaacgtaatgaggttattatcgaccgtgaaactgtgattgaagaggatcatatcgatgaaattatagactcaggcgttcagaatatccttgttcacaaggaagaagcgaattcatccgactactctattatatttaatacccttcagaaagacccgagcaactctgaaaaagaggctgtactttacatttaccgtcagttgcgtaatgcagatccggctgatgatgccagtgctcgtgaggttatcaataacctgttcttctctgaaaaaagatatgaccttggcgaggtaggacgttacagaatcaacaaaaagttgggactgactacggacatggatgtgaaggtattgacaaaacaagatattattgaaatcattaagtatctgattgagctgattaactctaaagcggatgttgatgatattgaccacttgagtaaccgtcgtgtacgtactgtaggagaacagttgtccaatcaatttgcgattggtctggcacgtatgtctcgtaccatccgtgagcgtatgaatgtgcgtgacaatgaagtgtttactccgattgatttgattaatgcgaagactatttcttctgttatcaattcattctttggaacaaatgctttgtcgcagttcatggatcaaactaatccattggctgaaatcactcacaagcgtcgtttgtcagcgttaggacctggtggtctgtcacgtgaacgtgctggttttgaggttcgtgacgtacactatactcattatggtcgtttgtgtccgattgaaactcctgaaggtccgaatatcggtttgatttcttctttgtgtgtgtatgctaagattaatgaacttggctttatttcaactccttatcgtaaagtagctgatggtaaggtggatatatctgatgaaggtattgaatatctgacagccgaagaggaagaggataagataatcgctcagggtaatgctccattggatgatgaaggcaaatttgttcgtgagaaagtaaaagctcgtcgtgatgctgattatcctgttgttactcctgaccaggtagagttgatggatgtttctccacagcagattgcttctatcgctgcttctttgattccgttcttggaacatgacgatgctaaccgtgcattgatgggatcaaacatgatgcgccaggcagttcctttgttgcgtacagaggctcctattgtaggtacaggtattgaaaaacagttggttgaagactctcgtactcagattgcagcagagggtgatggtgttgtagaatatgtcgatgcaacaactattcgtatcttgtatgacagaaatgaagatgaggaatttgtaagctttgaacctgctttgaaggaatacagaattcctaaattccgtaagactaatcagagcatgaccattgacctccgtcctacttgtgataaaggacagcgtgtgaagaagggtgatatcctgactgaaggatattcaactcagggtggtgagcttgcattgggtaaaaacctgttggtggcttatatgccttggaaaggttataactacgaggatgctattgtattgaatgaacgcgttgtacgtgaggacttgctgacttctgtacacgttgatgaatatattttggaggtccgcgaaacgaaacgcggtatggaagaattaacttctgatattcctaacgtgagtgaagaagctactaaagatttggatgaaaacggtattgtacgtgtaggtgcacgtatcgaaccgggtgatatcctgattggtaagattactccgaaaggtgaatcagatccttctccggaagaaaaattgcttcgtgctattttcggtgataaggcaggtgatgtgaaggatgcttcattgaaagcttctccgtcattacgtggtgtcgttattgacaagaagttgttctcacgtgttatcaagagcagaagtgagaagaatgccgataaggctattctgcctaaactgaatgatgaattcgaagaaaaggcagcaaaactgaaagatatcttgattgagaaactattggttttgactaatggtaaggtttcccaaggagtgaaagattatttgggaacggaagttattgccaagggggcgaagttcaccaaacgcgatttggaatcattggattatactattatccagttgagcaagtggacagctgatgctcataagaatgacatgattcgtgacttggtgatgaattatttgaagaaatataaagaattggatgctgaattaaagcgtaagaagtttgctatcactatcggtgatgaacttcctgcgggcattattcagatggctaaggtttatattgccaagaagcgtaagattggtgtaggtgataagatggcgggacgtcacggtaacaagggtattgtttctcgtgtggttcgtcaggaagatatgccgttcttagcagatggtactccagtagatatcgtattgaatccgttgggtgtgccttctcgtatgaatattggtcagattttcgaagccgtattaggtcgtgccggaaaagagttgggtgtgaaatttgctactcctatttttgacggtgcttctatggatgatttaaatgaatggacagataaagctggattgcctcgttattgtaagacttatctttgtgatggtggtacaggcgaacgctttgaccaacctgcaacagtgggtgtaacttatatgttgaaactagggcatatggttgaagataagatgcatgcccgttctatcggtccgtactcccttattactcagcagccgcttggtggtaaggcacagttcggtggtcagcgtttcggagaaatggaagtttgggcgcttgaagcattcggcgcagcacatatcttacaggaaatcctgaccattaagtctgatgacgttgtaggacgctcaaaggcttacgaagctattgtgaaaggtgaacctatgccaactccgggtatccccgaatctctgaatgtattgttacacgaactgagaggtcttggcttgagtatcaaccttgaataataaaaaaatataactctttacattataaataaggaagtatggcttttagaaaagaaactaagataaagagtaatttctcgaaaatctcaattggcttggcttcacccgaagaaatccttgagaattcgagcggtgaggtgttgaagcctgaaacgatcaactaccgtacctacaaaccggaacgtgatggtttgttctgcgagcgtattttcggtccggtgaaagattacgaatgtcattgcggtaagtacaaacgtatccgttataaaggtattgtttgtgaccgatgtggcgttgaagtgactgaaaagaaggtccgtcgtgaacgtatgggacatattcagttagttgtgcctgtagcgcatatctggtattttcgttcattgccgaacaagatcggttatttgttggggctgcctacaaagaaactagacgctattgtatattatgaacgttatgtggttatccagccgggtgtgaaggctgaagatggcattaataaatatgatttgctttctgaagaagagtatttggatatcttggatacacttcctaaagaaaaccaatatttggaagatacagatccgaataagtttatagctaagatgggagcagaagccatttatgatctgctctcaactttggatttggatgctttatcttatgaattacgtcataaagcaagtaatgattcttcgcagcaacgcaagaacgaggctttgaagcgtctgcaggtagttgaatcgttccgtgcatctcgcggacgtaataaacctgaatggatgattgtacgtattgtgccggttattcctcctgaactgcgtccattggttccgttggatggtggccgtttcgctacctctgacttgaatgacttgtatcgtcgtgtgattatccgtaacaaccgtttgaagcgactgattgaaatcaaggctcccgaagtgattttgcgtaacgaaaaacgtatgttgcaggaggctgtcgattccttgttcgataactcacgtaaatcaagtgcagtgaagactgacgctaatcgtccattgaaatcactgtccgatagcttgaagggtaagcaaggacgtttccgtcagaatttgctgggtaagcgtgttgactactctgctcgttcggttattgttgttggtcctgaattgaagatgggtgaatgtggtatccctaaactgatggctgcagagctttacaagccgtttatcatccgtaagttgattgaacgtggtattgtgaagactgtaaaatctgcaaagaagattgtagaccgcaaggagcctgtgatctgggatatcttggaacatgtcatgaaaggtcatcctgtattgctgaaccgtgcgccgactctgcaccgtttgggtattcaggctttccaaccgcatatgattgaaggtaaagctattcaattgcacccgttggcttgtacagcgttcaatgccgacttcgatggtgaccagatggcggttcacttgcctttgagtaatgatgcgattctggaagcacagatgttgatgcttcaagctcataacattctgaatcctgctaatggtgctcctattactgtgcctgcacaggatatggtacttggtttgtattatattaccaagctgagaaaaggggctaaaggtgaaggcttgactttctacggtccggaagaggctttgattgcttataatgaaggtaaagtggatattcatgctatcgtcaacgtagtggtgaaggacttggacaaagatggcaaaatcgtagatgtgatgatgaaagaaacctccgtagggcgtgtgattgtaaatgaaatcgttccagcggaagtggggtacttgaataccattatttccaaaaagtctttgcgagatatcattagtgatgttatcaaagctgtcggtgttgcacgtgcttgtgaattcttggatggtattaagaacttaggttactatatggcgttcaagggtggtctgtcattcaacttgggtgatattattatcccgaaagaaaaagaagaactggtaaaacgtggtaatgaggaagtggaacagattatgatgaactataatatgggtttcattactgacaatgaacgttataaccaggttatcgatacatggactcacgtgaacagtgacctgtctgatatactttacaagacgattaagaatgatgaccaaggcttcaattcagtatttatgatgcttgattccggggcccgtggttctaaagagcagattcgtcagttgtctggtatgcgtggtttgatggcaaaaccgcagaaagccggtgctgaaggcgcacagattattgaaaaccctattctttcaaactttaaagaaggtttgtctgtgttagagtattttatttctacccacggtgctcgtaaaggtttggcggatacagcgttgaagactgctgatgcgggatacttgacccgccgtctggtagacgtgtcgcatgatgtgattatcaatgaagaagactgtggaacacttcgtggtttggtttgtacggctttgaagaataacgatgaagttattgctactttgtacgaacgtattctaggacgtgtttctgtacatgatatcgtccatcctactactggtaaactgattgtagccggtggagaggagattacagaggatattgcgcaggaaatcgaggattctccgattgaaagcgttgaaatccgttcggtattaacttgtgaatctaagaaaggggtatgtgctaagtgttatggacgtaacttggcatccagtcgtatggttcagaaaggtgaagcagtcggcgtaatcgctgcccaatctattggtgagccgggtacacagttgacattgcgtacattccatgccggtggtatcgcaggtaatatggctgctaatgcaagcattgtggccaagaataatgcacgtttggaattcgaagaattgcgtacggtagatacggttgatgaaatgggtgaggctgtgaaagtggtagtcggtcgtttggctgaagtccgctttatcgatgtgaatacagggattatcctgtcaactcataatgtgccttatggttcaaaattatatgctgcggacggtgatattgttgagaagggaaaactgattgctaagtgggatccgttcaacgctgttattattacagaggctactggtaagattgaattcgagagtgtggttgaaaacgtaacttataaggtagagtctgatgaagctaccggtttgcgtgaaattatcattatcgagtctaaggataagacaaaagtaccttctgcccatattgtaaccgaggatggtaatttgatccgtacttataacttacccgtgggggggcatgttgtggttgaaaacggtcaggcagtgaaagctggtgacattattgtgaagattcctcgtgctgtaggcaaggctggtgatatcactggtggtcttcctcgtgttacagaactgtttgaggctcgtaacccatctaatcctgctgtcgtttctgaaatagacggtgaaattactatgggtaagattaagcgtggtaaccgtgaaattattgtcacatctaagacaggtgaagtgaaaaagtatttggtgaatctgtctaaacaaatattggttcaggagaatgactacgttcgtgccggaactccgttatctgacggtgcgattactcctgctgacattttggccattaaaggtcccacggctgtacaggaatatatcgtaaatgaagtgcaagacgtttaccgtttgcagggtgtgaagattaacgacaaacactttgagattattgttcgtcaaatgatgcgtaaggtagaaatcgatgagccgggcgatactcgcttcttggaacagcaggtagtggataagcaagagttcatggaagaaaacgatcgtatttggggcaagaaagtagttgttgactctggtgattctcagaatttacagccgggtcagattgttactgcccgtaagttgcgtgatgagaacagtatgttgaaacgtcgtgatttgaagcctgttgaggtacgtgatgctattcctgctacatctactcagattctgcaaggtattacccgtgccgctttgggaacttcaagtttcatgtctgctgcatcattccaggaaacaacgaaagttttgaatgaggctgccatcaatggtaaggttgatagattggagggtatgaaggagaatgtgatttgtggtcacttgattcctgccggtaccggtcagcgtgaattcgaaaagattattgttggttcgaaggaagaatatgatcgcattcttgctaatcgtaagaatgtactcgattatagtgaggtagagtaatttttaatacatacactgtaaaagaggctgatttctgtttaagaaatcagcctctttaggtttatagtaaatgctataggaaaattatatagaataatcagtatgttgtattattacaaataaatgtctatatttgtactccaaccaaagaatagaagttggggaccttgaaattcagaatatttttttaatgctaaagtataaaatcatggaaaacgaaaaaaataacaatcagttgcagatagagttgaaagaagaagtagctcaaggaacgtatgcaaatcttgccattattacccattccagttcggaatttattgttgattttgtgcgtgtaatgccgggattacctaaagctggagtgcagtcacgtattgtactgactcctgaacatgcaaaacgtttgatgtatgcattacaggagaatgttgcaaaatacgaacgtaattttggacctattcgaatgccggaagaaatgaatgggggaaataatggaccggatggaaaaacattcattcctcctataagcggatttaaaggggaagcataagggcttttgtagcaaaaataacatagtagtctgtttttcaaaaacttttttgagaaacagactatttttattagtagaaagtattgtttattaaaatgttattcgtaactttgcagcccaaaatgtatagttttggacttagtacagcaaattaataaacaatatataataattaaaaatcaaacaaaatgcctactattcaacaattagtaagaaaaggaagagaggttttggttgagaagagtaaatctccggcactggattcatgtcctcaaagacgtggcgtttgtgttcgtgtgtatactactactccgaaaaagccgaattcagcaatgcgtaaagttgctcgtgtgcgtctgactaactctaaggaagtaaactcttatattccgggagaaggtcataacttgcaggaacactcaatcgtgttggttcgtggtggtcgtgtgaaagaccttccgggtgtacgttatcacatcgttcgtggtactttggatacagcaggcgtagctggtcgtacacaaagacgttctaaatatggtgcgaagcgtcctaaagcaggacaagctgcagctcctgcaaaaggaaaaggaaagaagtaaattgtaactgaattcctgaaacaaagaatattaatttaagttttggtttgttggaataagctataaaggttgagtaaatgcttcagaggaagcgttgaagtaaacggaaaaagtgcagccccaaacaaaaacattattttgagaaaaaatgagaaaagcaaaaccaaaaaaacgtgtgatccttccggatccggtatttaatgatcagaaggtttctaaattcgtaaatcacttgatgtatgatggaaaaaagaatacatcttatgagatcttctatgcagcactggaaacagtgaaaacaaaacttcctaatgaagaaaaatcagctttggaaatctggaagaaagctttggataatgtaactccgcagattgaagtaaagtctcgtcgtgtaggtggcgctactttccaggttcctactgaaattcgtcctgatcgtaaagagtcaatctcaatgaaaaacttgattcttttcgctcgtaaacgcggtggtaaatcaatggcagataaactggcagctgagattattgacgctttcaacgaacagggtggtgcttataagcgtaaagaagatatgcaccgtatggctgaagctaaccgtgcattcgctcactttagattctaatcaagtaataattaataagtaaaggacgaagatggctaaacatgatttgcatttgacccgcaatatcggtatcatggctcacattgatgctggtaagacaacgacttcagaacgtattttgttctacactggcttgactcacaaaattggtgaggtgcatgatggtgcagcaacaatggactggatggagcaggagcaggaacgtggtattactattacatctgctgctactactactcgttggaaatatgcgggaaatacttataaaataaacttgattgacactccgggacacgttgactttactgctgaagtagaacgttctttacgtgtcttggatggagctgttgcagcttattgtgcggttggtggtgttgaacctcagtcagaaaccgtatggcgtcaggctgataaatacaatgtgcctcgtattggttacgttaataaaatggaccgttctggtgctgactttttcgaagttgttcgccagatgaaggatgtattaggcgcaaatgcttgccctgtggtaattcctattggtgctgaagagagcttcaaaggagttgttgatttgatcaaaatgaaagctattttgtggcacgatgaaacaatgggtgcagattatagcgtagaagaaattccggcgaacttggttgatgaagctaatgaatggagagagaaaatgctcgaaaaagtggctgaatttgacgatgctttaatggagaaattctttgatgatccttctacaatcactgaagaagaaatcttgcgtgctttgcgtgcaggtacattgaaaatggatatcgttccgatgttctgcggctcttcattcaagaataagggagttcagacattgcttgactatgtttgtgcgttcttgccttctccgttggatacacctgctattgtaggtactaatccgactacaggagcagaggaagaccgtaaacctagcgaggatgaaaaaacatcagctttggcatttaagattgcaactgacccctatgtcggacgtttgactttcttccgcgtttactctggtaaggtagaggctggttcatatatctataacactcgttcgggtaaaaaagaacgtgtatcacgtttgttccaaatgcactcaaacaaacagaatcctgtagaggtgattggagctggtgatattggtgccggtgttggtttcaaggatatccgtacaggtgatacgttgtgtgatgaagatgcaccgatcgtattggaatcaatggaattccctgatcctgtaattggtattgcagttgaacctaagactcagaaagatttggacaagttgtctaatggcttggctaaactggctgaagaagacccgacatttactgttaagactgatgagcagtccggtcagactattatttccggtatgggtgagcttcatttggatattattatcgaccgtctgaaacgtgagtttaaagtagaatgtaaccaaggtaaacctcaggttaactataaggaagctatcactaagactgttgaattgcgtgaagtttataagaagcagtctggtggtcgtggtaagtttgccgatatcattgtggcaatcggtccggttgacgaagactttacacaaggtggtttgcagtttattgatgaagtgaagggcggtaatgttcctaaggaatttatcccatcagttcagaaaggtttccagaccgcaatgaagaatggtgtgttggcagggtatccgcttgattcactgaaagtagttttgaaggatggttcattccatccggttgactctgaccagttgtcattcgagatctgtgctatccaggcttacaaaaatgcatgtgctaaagcaggtcctgtattgactgaacctattatgaaactggaggttgtaactcctgaagaaaacatgggtgatgttattggtgacttgaataagcgtcgtggtcaagtagaaggtatggaatcaagccgttctggagctcgtattgtaaaagctaaagtacctttggcagaaatgtttggttacgtaacagctttgcgtactattacttcgggtcgtgctacatcgtctatgacttatgatcatcatgctcaagtttccagctctattgctaaggctgtacttgaagaagtgaaaggtcgcgtagacttagtataataaaaaaaagcaggggctacgggttagcgaatgactcttaatccggccccactttatatttaatcattttttaatttaaaatttaatgagtcaaaaaattagaattaaactgaaatcttacgatcacaacttggtagacaagtctgctgaaaagatcgttagaacagtgaaggcaacaggtgctattgttagcggtcctattccattgcctacacacaagcgtatttttacggtaaaccgttcgactttcgttaacaagaagtcacgtgaacagtttgaattgtcttcttacaagagattaatcgacatctatagctcaacagctaagacagtagacgctctgatgaagttggaattaccgagtggagttgaagtagaaattaaagtttaatgcatttaaaaattaactgaaatgccaggattattaggaaagaaaatcggaatgacatccgttttcagtgctgatggtaaaaatgtaccatgcactgttatcgaagctggtccttgtgtagttactcagattaagagtgttgagaaagacggctatgcagctgttcaggtaggtttccaggacaaaaaggaaaagcatactaccaaacctttgatggggcactttaaaaaagctggtgtaactccgaagagacacttggccgagttcaaagattttgaaacagaattgaatttgggagacactattacagtggagttgttcaatgatgcggcttatgttgacgttgttggtacttctaaaggtaaaggcttccaaggtgtagttaaaagacatggatttggtggagtaggtcagactactcacggtcagcacaaccgcgctcgtaaaccgggttctatcggtgcatgttcttaccctgcaaaagtattcaaaggaatgcgtatgggtggccaaatgggtggtgaccgcgttactacacataacttacaggtattaaaagtgattccggaacacaatcttcttttgattaaaggttcggtaccgggttgcaaaggttcaatcgtaataattgagaaataatggaagttaacgtattaaatattaaaggtgaagacaccggaagaaaggttacgttaaacgaatctatcttcggaattgaacccaatgaccacgctatctatttggacgttaagcagtttatggctaaccaacgtcagggaactcataaatctaaagaaagaagcgaaatcagcggttctactcgtaaattaggtcgtcagaaaggtggtggcggtgctcgtcgtggtgatatcaactctccggtattggtgggtggtgctcgcgtgtttggtcctaaacctcgtgactattggtttaagttgaataaaaaagttaagacattggctcgcaagtcggcattgtcttataaagctcaagaaaacgcaatcattattgttgaagacttcacatttgaggctccaaagactaaggatttcgtttctatggtaaataatcttaaaattgctgacaaaaagttgcttcttgttttgccggaagctaataaaaatgtatatttgtcagctcgtaacatcgaacgtgctaatgtagcaattgcttctgcattaaatacttacaatgtattgaatgctgaaactcttgttgttacagaaaactcgctcaaggctatcgagaatatcttatcttaatttaaaaaggaggcttagataatgggaattattattaaaccgttggttactgagaaaatgactgcaattaccgagaagttaaatcgattcggctttattgtacgtcctgaagctaacaagttggaaattaagagtgagattgaagctttgtataatgttacagtagtagatgtaaatacgctaaaatactcgggaaagagtaaaagccgttacactaagtctggaatcatcaatggtcgtacgaatgcttataagaaagctatcgtaacattgaaagaaggcgatactattgatttttatagcaatatttaataaagatggcagtacgtaaatttaagcccacaacaccggggcaaagacataaaattattggtacttttgaagagattactgcatcggtaccagaaaagtctcttgtatttggaaagcgctcaacaggtggtcgcaacaacgttggtaaaatgacaatgcgctatatgggcggtggtcacaagagaaaatacagacttattgatttcaagagaaacaaagacggtgtacccgcagttgttaaaactatagaatacgatccgaatcgttcggctcgtattgctttgctgttttatgctgatggtgaaaagagatatattattgctcctaatggattgcaagttggtagcacattgatgtctggagcgaatgcagcgcctgagattggtaacgcacttccgcttgaaaacatccccgttggtactgtaattcataatatagaattacgtccgggtcaaggtgcagctttggtaagatcagctggtaattttgctcagttaacttcaagagaaggcaagtattgtgtgattaaattgccttcaggtgaggtaagacaaatacttagtgcttgtaaggctactattggtagcgttggtaactctgatcatggattggaatcttccggtaaggcaggtcgtactcgttggatggggcgtcgtcctcgcaaccgtggtgttgttatgaatcctgttgatcacccgatgggtggtggtgaaggacgcgcttcaggaggtcatccaagatcacgtacaggcttgtatgctaagggcttgaagacaagagctccgaagaaacagtcttctaagtatattattgagagaagaaagtaataactgattaattgagtaaattatgagtcgttcattaaaaaaaggtccatatattaacgttaaacttgaaaagaaagtgcttgctatgaatgaaagcggcaagaaggttgtcgttaagacttgggctagagcttcgatgatctcgcctgattttgtagggcacacagttgcagttcataacggaaataaatttattcctgtttacgttacagaaaacatggtaggacacaaattgggtgaatttgcaccgacacgtacattccgcggccatgcaggtaataagaaaaaataagcaggataatctgaagaaataataaagtaataaataatgggagcaagaaaaaaaatatcggctgaaaaaagaaaagaagcccttaagaccatgtattttgcaaagttgcaaaatgttcctacttctccgcgaaaaatgcgtctcgtggctgacatgatccgtggtatggaagtgaaccgtgcactgggtgtcttgaagttttcttctaaagaagcttctgcaagagtggaaaaactgttgcgctctgctattgctaactgggaacagaaaaacgaacgtaaggcagaaagtggcgaattgtttgtaacaaagatttatgttgatggtggtgcaacgctgaaaagaatgcgtccggctccgcagggaagaggttacagaattcgtaaacgttcaaatcacgtgactttgttcgttgattctaagagtactaatgataatcaaaattaagactagatgggacagaaagttaatccgataagcaaccgtttaggaattatcagaggatgggattctaattggtacggtggcaatgattatggtgatgctttgttggaagacagcaaaatccgtaaatatttgaatgccagacttgcaaaagccagcgtttcaagaattgttattgaacgtacactgaaattggtgacaattacggtttgtacagcacgtccgggtattatcattggtaaaggcggtcaggaagttgacaagctgaaagaagagttgaagaagatcacggacaaagatattcagatcaatatctttgaagtgaagagacctgagttggatgctgttattgtagctaataatatcgctcgtcaggtagaaggtaagattgcctatcgccgtgccatcaagatggctatcgctaacacaatgcgtatgggcgctgaaggtatcaaagtgttgatttcaggacgtttgaatggagcagaaatggcccgttctgaaatgtataaagaaggaagaactccgttgcatactttccgtgcagatattgactactgtcatgcagaagctttgactaaagttggtttgctgggtattaaagtatggatttgccgtggtgaagtgtatggtaagagagaattagcgcccaactttactcagactaaagagagtggtcgtggtggtaatggcaacaataacggtggtaagaacttcaaaagaaagaaaaacaatcgctaacggatttgaattttaggaattatgttacaaccgaaaaagacaaaattcagaagacagcagaagggcagtcagaaaggaaatgctcaaagaggaaaccaattggctttcggctcatttggtattaaatctttggagactaaatggattacaggtagacaaattgaagctgcacgtattgcggtaacaagatatatgcaacgtcaaggacagatttggatccgtattttcccggacaaacctattactcgcaagcctgctgatgtgcgtatgggtaaaggtaaaggtgctcctgaaggtttcgttgctccggttactccgggtcgtattatcatcgaggcagaaggtgttccttatgaagtagctaaagaagctttgcgtcttgcagcacagaagcttcctgttactactaagtttatagttagacgtgattacgatgctcaaaatcaaaatgcttaatttattatgaagattgcagaaattagagaaatagctaccaatgaattggcagaaagaattgaagctgaagtagccaattacaatcagatggttttaaatcattctatctctccgctggataatcctgcacagattaaaaagttacgcagaacgattgcgcgtatgaaggcagaattgcatcagagagaacttaacaaataataatggtcctcatggaagctagaaatttaagaaaagaaagaacaggtgttgtagtaagcaataagatggataagaccattactgttgctgctaagtttaaagaaaaacaccctatttatggtaagttcgtttctaaaacgaaaaaataccatgctcatgatgaaaagaatgaatgtaatgtaggtgatacagtacacatcatggaaactcgtcctttgagcaaaactaagagatggagattggttgaaataattgaaagagctaagtaattatgatacaagtagaatccagacttacagtgtgtgacaacagtggcgctaaagaagctctttgtatccgcgtattaggcggtacgaagagacgttacgcttctgtaggggatgtcattgtagtttctatcaagagtgtaatcccctctagtgatgttaaaaaaggtgcagtatcaaaggctttaattgtacgtactaagaaagaaatccgtcgtgctgatggttcttatattcgttttgatgataatgcttgcgtattgttgaataatgcaggtgaaattagaggaagtcgtatttttggccctgttgcaagagagttgcgtgctgcaaacatgaaagtggtatcacttgcacctgaagtactttaattttgtaaaagatttaagtaatgagtaaattacatataaaaaaaggcgatacagtttacgtaaactctggtgaagataaaggtaaaactggccgtgtgctgaaagttcttgttaaagaaggacgtgcacttgtagaaggtatcaatatggtatcgaaaagtaccaaacctaatgcaaagaaccctcagggtggtatcgtaaagcaggaagctgctatacatatctcaaacttgaatttggttgatcctaaaacaggcaagccaacacgtgtgggaagaagagaaagttctgatggtagaacatttgttcgttatgctaaaaaatcaggagaggagattaaataatgagtaatactgctagccttaagaaagaatatgcagagcgcattgcgcctgcattgaagaatcagttccaatattcttcaacaatgcagatccccgtacttaagaagattgttatcaatcaaggattgggtatggctgttgctgataagaagattattgaagttgctattaatgagttaacagcaattactggtcagaaagctgttgcaacagtttcacgtaaagatatcgctaactttaagttacgtaagaaaatgccgattggcgtaatggtgactttgcgtcgtgaaagaatgtatgagttccttgaaaaacttgttcgtgttgctttgccacgtattcgtgacttcaaaggtatcgaaagcaagttcgatggaagaggtaattatacattgggtattcaggaacaaatcattttccctgaaataaatatcgatagtattactaaaattctcggaatgaatattacctttgtaacttctgctccgacagatgaagaaggttatgctttgttgaaggaatttggtttaccgtttaaaaactcaaaaaaagattaatatattatggcaaaagaatcaatgaaggctcgtgaagtaaaaagagccaaacttgtagccaaatatgctgaaaaacgtgctgcgttgaaaaagattgtcaactcaggtgatcctgctgaagcttttgaagctgctcagaaattacaggctattcctaagaatgctaatcctattcgtttgcacaaccgttgtaaattgaccggtcgtcctaaaggctatattcgtcagttcggaatttcaagaattcagttccgcgaaatggcttctaatggtttgattccgggcgtaaagaaagcaagctggtaattctttttatttttaaatattgtcagggtagtcctgattaatttaatttattattatatgacagatccaatcgcagattatctcaccagattgagaaatgcaattagtgcaaagcacagagtagtagaagtgcctgcctcaaatttgaaaaaggaaatcactaagatccttttcgacaaaggctacattctgaactacaagtttgtagaagatggtcctcaaggaactatcaaagtggctttgaagtacgactcagtaaacaaagtaaatgctattaagaagcttattagagtttctactccgggtttacgtaagtatacgggttacaaagacatgccgagagttattaatggtttaggtattgctataatatctacttccaaaggtgtaatgactaacaaagaagctgctgaactgaaaatcggtggtgaagttctttgttacgtatattaataggaggataagcaatgtcaagaataggaaaattacccattagtattcccactggagtaacagttactctgaaggataatgtagttactgtaaaaggtcctaaaggcgaacttagccaatttgttgatccttctatcaatgttgcaattgaagatggacatgtgatgttgacagaaaacgaaaacgcgatgttggataacgtaaaacaaagacatgcttttcatggcttgtatcgttctttggttaacaacatggttattggtgtttctgaaggttataagaaagaactggaacttgtcggtgtaggttaccgtgcttcaaacaatggtaatattattgatttcgctttgggttatactcataatatctttatgcagttacctcctgaaatcaaggtagaaactaagtcagaaagaaataagaaccctcttattatattggaatcttgtgacaaacaactgctgggtcaggtttgttcaaaaatacgttctttccgtaagccggaaccttataaaggtaaaggtattaagtttgttggcgaagaaattcgtagaaagtctggtaagtcagccggtgctaaataatttacataaaattgtattatcatgacaacaaaattagaaagacgaatcaagatcaaatatagagtacgcaataagatttcaggtactactgaacgtccgcgtatgagtgtgtttagaagtaacaagcagatttacgttcaagttatcgatgacttgtctggtagaactttggctgcagcttcatctttgggaatggaagctatgcctaagaaagaacaggctgctaaagttggtgaactgattgccaagaaggctcaggaagctggtattacgactgtcgtattcgaccgtaatggttacttgtatcatgggagaataaaagaagtagctgacgctgctcgtaacggtggacttaaattttaatcaattatggcagttaataatagagttaagataactaacgatatagagttaaaagacagattggttgctatcaaccgtgttacaaaggtaacaaagggtggtagaacattcagcttctctgcaattgtcgttgttggaaacgaagacggtattattggttggggccttggtaaagcaggtgaagtaacagctgctattgctaaaggtgttgaagcagctaaaaagaacttgactcgtgttcctgtattgaaaggtacagttcctcatgaacagtcggctaaatttggtggtgctgaagtattcatcaagccggcttctaccggtactggtgtggtagcaggtggtgcgatgcgtgctgttttggaaagtgtgggtgttacagacgttttggctaagtcaaaaggttcttctaatccgcacaacttggtaaaagctactattttagctttgggcgagatgagagatgcccgtatggttgctcagaacagaggcgtaagtatggaaaaagtatttagaggataaggaggaattatgtcaactattaagattaaacaagtaaaaagtagaattggtgctcctgctgatcaaaagagagtactcgatgcgctgggacttcgcaagatgaatcgtgtggttgagcacgaagcaactccttctattctgggaatggttgaaaaggtaaaacacctggttgccatcgttaagtaattcattgttaataaaaaaactaattacgatatgaatttaagtaatttaaaacctgcagaaggatctacaaagactagaaaaagaattggccgtggcccgggatctggtttgggtggtacttctacaagaggtcataaaggtgctaaatcaagatcaggttattcaaagaagattggttttgaaggtggacagatgcctcttcaacgtcgtgttccgaagtttggttttaagaatattaaccgtgtagaatataaagctattaaccttgaaactattcagaaattggctgaagctaagaatctgactaaggtaggtatgaatgactttattgaagctggtttcatttcttctaatcaattggtaaaagtactaggtaacggtagtttgactactaagcttgatgtggaagctaatgctttttcaaagagtgcggtagctgcaatcgaagctgttggtggtaatgcagtaaaactctgattcaatgagaaaatctattgaaacattaaagaatatatggaaaattgaggatctgagacaaaggatcctcattactatattatttgttgcaatttacaggtttggttcttacgtggttctgccaggtattaaccctgctatgttaactcagttgcataaacaaacgagtgaaggtttgttagccttgttaaacatgttctctggaggagcgttttccaatgcatctatttttgcattgggaatcatgccatatatctcggcatcaattgtaattcagcttttggcgattgctgttccctactttcagaaaatccagcgtgaaggtgaaagtggtagaagaaaaatcaatcagtatactcgtatattgacaattgcaattttggttttccaagctccctcatacttgcttaaccttaagatgcaagccggaccatcacttaatgcttcattagattggacattctttataattacttctaccatcattttggcagctggaagtatgtttattctgtggcttggagaaagaataacagataaggggataggtaatggtatatcattcatcattttgattggtattattgcccgtctgccacaatctttattccaagagtttgtttctcgtctggcttctccgggtgcaggtggtatcatcatgtttttgttggaaatagtatttttgttgttcgttattgcagcagcaattttgctggttcaaggcgtccgcaaagttcccgtacagtatgcgaaacgtattgtaggaaacaaacaatatggtggtgcaagacaatatattcctttaaaggtgaatgctgcgaatgtaatgcctatcatctttgcccaggcaatcatgtttatccctattacattggtaggtttctcaaatgctgcaacagcaagtggtattgtacgtgcatttgtagatcatactagcttctggtataattttgtttttgcaatattgattattgtgtttacatacttctatactgcaataacaattaatcctaaccagatggcagaagatatgaagagaaataatggttttattccgggaataaaaccaggtaagaatacagctgagtatatagatgcgatcatgtctcgtattactctgccgggttctatattcttggctcttgtagccatcatgcctgcatttgccggtatttttggagtaaaagctgagttcgcccagttcttcggtggtacatccttattgattcttgtaggtgttgtattggatacactccaacaggtagaaagtcatttgctgatgcgccattacgacggattgttaaattccggaagaatcaaggggcgtgctggtaatgttgctgcatattaattagtctgagatgatatttcttaagacagatgatgagatagagctgcttcgtcagagtaacctacttgtaggtaggactctggctgaagttgctaaattgataaaacccggtgtgacaactaaggaacttgacaaggtggctgaagagtttattagagataatggagctgttcctacttttaaaggttttcccaatcagtatggtgatccgtttcccagtaccttgtgtacttcggtaaatgatcaggttgtacacggtattcccaatgatatccctttgaaagaaggtgatattgtttctgttgattgtggtacttatatgaatgggttttgtggggattcagcttataccttctgtgtaggagaagttgatcctgaggtcttgaaacttttgaagacaacaaaagaagctttatatttaggtatagagaatgccattcatggaaagcgtttgggtgatataggttttgctgtccagcaacattgcgaggctaattcctatggtgtggtaagagaattcgtaggtcatggtattggaaaagatatgcatgaagatccgcaggtacccaattatggaaaaagaggatacggcactcagttgaaaaagggtatgtgcattgccatcgaaccgatgataacattgggttcccgccagatagtaatggaaagagatggatggacagtgcgtacacgcgataggaaatgtgccgctcactttgagcatacagttgcaataggagttgggaaggcagatattttgtcctcatttgaatatgtcgaacaagtattaggagataaagcaatttaatatggcaaagcaatccgcaatagaacaagatggagttatagttgaagcattgtctaatgcaatgtttcgtgttgagctagaaaacgggcatgagattactgctcatatctctggcaagatgagaatgcattacattaaaatattacccggggataaggtcagagtagagatgtctccttatgacttatctaaaggaagaatcgtttttagatataaataaaaaagaaataagatatgaaagtaagagcatcattaaagaaacgtacgccggaatgcaaaatcgttagacgaaatggccgtttgtatgttattaacaagaaaaatcctaagtataaacaacgtcaaggataatttattatttttgcaaaaaaaataatttagtatatggctataagaatagttggtgtagatttgcctcagaataagagaggcgagattgcgttaacctatgtatatggtattggacgcagtagttcagcaaaaatcttggataaggctggtgttgacagagatgtgaaagtaaaagactggacagatgaccaggctgctaaaattcgtgaaatcattggtgctgaatacaaagtagaaggtgatcttcgttcagaagtgcaattaaacattaagcgattaatggatattggttgctatcgtggtgtacgtcaccgtattggtctgccggttcgtggccagagcactaagaacaacgctcgtacacgtaagggaagaaagaaaacagttgcaaataagaaaaaagctactaaataataattgttgatatggcaaaaaaaacagtcgcagctaagaagagaaatgtgaaggttgacgctaatggacagttgcatgttcattcttcattcaacaacatcattgtatctctggcaaatagtgaaggtcagattatctcatggtcttctgcaggtaagatgggatttagaggttctaagaagaacactccttatgcagcacagatggctgcacaagattgcgctaaggtagcgtttgatcttggcctgagaaaggtgaaagcttatgtaaagggtcctggaaacggacgtgagtctgctatcagaactgttcacggagctggtatcgaggttactgaaattattgatgtaactccgcttccgcacaacggttgtcgtcctccgaaaagaagaagagtttaatagataacctatttttatatgtaacttgattttgttaataatggattgcacttcctttctgtaatcgcggctgcaacaaattaagttcattagtaacaattaaattagaaaaagaaatggctagatatactggaccaaaatcaagaattgcccgtaaattcggtgaaggaatctttggagcagataaagttttatctaagaagaattatcctcccggacaacatggtaacaacagaagaagaaagacttctgagtatggtgtcatgttggcagaaaaacaaaaagctaaatatacttacggtgtattggaaaaacaattccgtaacctgtttgaaaaggctgcaagtgctaacggtattaccggtgaaatcttgttgcagagtttagaggctcgtcttgacaacgtggtgttccgtttgggtattgctccgactcgtgctgctgcccgtcagttagtaagtcacaagcacattacagtagatggaaaggtagttaatattccttcattctctgtaaaacccggtcagattgtgggtgtacgcgaaagatctaaatctttggaagtgattgctaattcacttgcaggattcaatcacagcaaatatccttggttggagtgggatgaaagttctaaggtaggtaagttgttacatatacctgaaagagcagacattcctgaaaacattaaagaacacttgatcgttgaattgtactctaaataataattaatttcatggcgatattagcatttcaaaaacctgataaagtattaatgttggaagcggactccagatttggaaaatttgagttccgtccactcgaacccggtttcggtattaccgtaggtaatgctttacgccgtattcttctttcttcattggaaggatttgcaatcaacacgattaagatcgaaggtgtagaacatgagttcgcatctgtacccggtgttaaagaagacgtgaccaacattatcttaaatctgaagcaagtcagatttaagcaagtagtagaagagttcgaaaatgaaaaggtaagcattaccgttgagaattctagtgaatttaaggcaggtgatataagtaagtatttgactggatttgaagtgttaaatcctgaattggttatttgccatttagattcaaaagcaacaatgcagatggacattaccattaataaaggtagagggtatgttccggccgacgaaaaccgcgaatattgtaccgatgttaatgtaattcctatcgattctatttacacaccgatacgtaatgtaaaatatcaggtggaaaacttccgtgttgaacagaagactgactacgaaaagctggtattggaaattactaccgatggttccattcacccgaaggaagctttgaaagaagctgctaaaatattgatttatcatttcatgttgttctctgatgaaaagattactcttgaaacatccgatgtggacggcaatgaagaatttgatgaagaagtattgcacatgcgccagctgcttaagactaagcttgttgatatggacctctcagttcgtgccttgaactgcttgaaagctgccgatgtggaaacattgggtgacttggtacagttcaacaagacagatctgttgaagttcagaaacttcggtaagaaatcgctcacggagcttgatgatttgctcgagggtctgaatctgtcgtttggaaccgatatctctaaatataaattagataaagaataaaaaatgagacataataagaaattcaatcatttaggtcgtactgcttctcatagaagtgctatgttatctaacatggcttgttctttgatcaagcacaaaagaatcactacgactgttgcaaaggctaaagctttgaagaaattcgttgagcctttaattacaaaatctaaagacgacacaactaattcacgtcgtgttgtatttagcaacttgcaagataagtttgctgtaacggagttgttcaaagaaatctctgtaaaagtagcagatcgtccgggtggttatactcgtatcatcaaaacaggtcatcgtttgggtgataatgctgaaatgtgctttatcgaattggtagattacgatgaaaacatggctaagactgcaactgctaagaaagcaactcgtactcgtcgttctaagaagagtgcagccgctacagaagctcctgcagcaccggcagctgaaactacagaggaagcccctaaagctgaataatctgtaatcatcatatatataaaagccatagctataaaagctgtggctttttttattttatgccctgaccggcagtaatgagaaaacaagctgtgaggcttctgtccacatgcatattacttgttctgtttacaaaagttttgatacggacgaggcatgcagaacaagaacagcttttaatttaaagtcggaattagaaacatcgaataattccttcaaaaccgtcatagataggtaacctgttgcttttcaggaagaaaccatgaaggaattgagaaccgatccttcataattttggataatccttcatagctcccttaaaacaaaatacctttgatatgtgttaattattgtatgaaatgaaacctaaaacgctatttatgttatctttgtaaaccaaacagtaagcaatgaaaggatttgttacagtcatattattttttctgtttgccttggcttttgccggaacagaatatgtagatgcagttccagctgcatcaatgacggtatgtactgtacagcatacggatactactccgcagcactccatcaatgaagatcgtgtcattcccttggatagcaataagggaatagcagatatggagtttggggacgctcatactttagcacatcgcgtcagtgcctctgcagagcgtatgtaccgtttttcctccatggagactacccaatttatcaaaattttgttgcgtaagatggccgcccggatggccagtcttgcaagctgtcatacccatgtgtatgcctcttcctattcccttccctgggatagtgcttgcgagcactatatctttggtatgaggcgcattcttatttagcttttattcttttaccaatttgtttttcatggttctgtcttgccgggtgattggcgagatgtgaccttggtatgaattattgtatttttaattagtaaagaataaaatttaaattattatgagtaatacagtttctactgaagcaaccttgttttcaacaacacaccctgatgtcgtaaaacgtactagtgtttcttctattatcatatccgctatcctttgtgtgataggtgcgggtgcatttgcaacctctttaaagatgggggattcctcatccaccatgagcatggtgcttatggccggtggaaccattttgtttctgtgggccgtattccgctttttctggcgaggcaaggaatgggtatatgcacctaccggcagcgtagctaaagaagggacctgcttctttgatgtatgcgatttacaggctttgacggatgcgttggagaaaaaaggttttgaaaccaggaatgacgtgaaagtaaagacaaacggaaacgtacgtatggactatatgatttctcaggacaagaaattcgttgcggcccagctgttccgtttcatcccctatacatacgaacctgcatcttctgtgttttatttcacgggagatgatgcaagtgcgtttgtacattgcttggaaacaagtgaattttgattttctatgactctttatgttatgaaataaggtgtgcctgtgaaggtctgctttatttgcttaagacgttaatgtgataaattgtcgggtggggttagtcgttgatgattagccccatctttttcatcaggaagcaggcattcatattttgtgcgataccttcacggagtttgtatgaaaaagtcagttcatcgttggtaatatcagcttcaaagcaataattccgtatctctttggggaaatattctattagtttccctaatagcaggtcgtgtgtggcaatgatgccattcgtcttcagttccatcagttggcgtaccagggcgaatgagcctttctgcttgtccatcgagttggttccttttaaaatctcatccagaatgatgaacaactcctctcccttattcaggcggtctataatttgtttcaatcgttttagttcggcaaagaagtaagattcgttgtctgtcaacgaatcggaagtccgcaagcttgtcactagtttggcaggatatatttcaagggaggaacagcatacggggcagccggtacatgccaatacataattcactccgattgtacgcagataagtactttttcctgccatgttggctcctgtgatgatgacaaagaacggtcttgaggggatatcggcatcattggtcacacattgccgtgcaggcatcaggggatgtcccatatcctttgcaaggaatacaaaaggcttgccggcaatggtcggataggtgtatgcgggatggttgccggcaaatgtcgccagggaacaaagagcatcaatgtcacccaatacgtccagccagtggagcagatattttccatatttgtgcctccattgctcaatgcgcattacctgccggagttgccagaacatggaaccttccagcaagacatatagcagttggttgttgcgcaagtccagtttgtccagttcccgtgaaagctctttcaagatatgggtggtggatttcccgttcatgccgaattcagctttcaggtgtctgagtagcggagcgttcatttcccggttttctatcaggctgatcagttcggcatagatagacaggatacgtaatttcttgtcatacactctttgcaggttgctgacaggctttatcagcccgaaactacctatcacgaacagtccgaaggccagtccgaaccatgtcatcggaatgacccccgccactcccagcatagccagtacgatgttgactccgggaacgattcccaataacgggcggctccaccatttcttgctgaaataggcaggtgcttccgtccactctttaatttcttcgcggtcgcttgtcgcccctttgtagagcaggccggtgatccggaatgtttcccggaaatcggaataagcagccagttcctttgtcgcctcctgccgttggattatctcttcctttatctccagatgattttgcaaccattctgccagtttttcctttccgaatgaagtgcaggtacggttcaaggcctggaacaaggagtgccttccgaacaagtccaggtcaaaagaatacctgtgggccgggtttgtgaattcctttccgtcctcaaaaggctcatagttgtccgccagtgcggaaagctcgtcactattcacccgtatgcaggtttccagccagtctttgcggaaaaacaaccggttgtgatacttcaccaatgccagaaaaggaacgaaagtgaccgctatggttagacatatagtgggtgtccctgcctgatagaagtagattgttcctataatccctgctgcaaataacaagaccctcagcgtgctgatgcggagaatcttattttttacctggcggagttctgcctcagcctgttcaatgcgctgttcgtattttgctttcaattccataatgataggttataaatatttccttgccataccgggcgcggttttgcagcggagagggggaagccttctgcggcgatgcaagggtatggcgaagaacttttcatttgttttccggcaaatatatagaaaaaaaaacgtctccttctgtttcttgtgttatttagacttatcttttcattttaggaagaagagccttccatccggaatgatggcggttagaccgatgaggatgcatgacaggaaatgaaattttaacatagccgatgaacccattgtcaataggaaaaagtatatttgtctgtctgacaaagattataaactacttggggtatgagaaaaatgatattcattttatgcattccgaccgctttgctttcggcttgctcaccatccggaatgcaaggcaatccggcggcagtacaagccggtgcggccatcggcggagtattaggcgctattgtgggtgacagggccggcggatacaacggttcgcaattcggcgctctgctgggaactgtaacgggggctgctgtgggaaatgccataactacacctcgggaggaaacttgtcaggtggaggagtattacgtaaagacttatccttcttcttcgcagtatgagcacacttcctcttatgagccttcatcgggattgaggattatcaacctgcgttttatcgatgataaccgtaaccatgttattgatgcggaagaagacagcaaactggtgttcgatgtggtgaatgatggtgatgtgcccgcttacaatgttactccggtaatagaggaaatgagcggcatgaaacatattttgatttcaccttcggctcagattgcctatatgcctgtcgggaatcagataaggtacacggccaccattcgtggaggcaggaagttgaaaacaggccaggcgcaattccgtgtttttgcaacagagagcaacggggcggtgaccgaagcgcatgagtttactttgcctacccaaaaacggataaagaaataagttccttcattggcggggcttctgcgggcggataacccttttccggagataacgtaagcattcgcagccctattgttaagcctttccgaccgtccggttactatctccaaagcctgcggagttatctccatagcctttggagttaactccgcaagctttggagataactccatagtgctatggagatagtatatatcctttcttcagaccttagcaggcgggagaaaaggccttatggtgggggatgtgtggagttactccttgttgatgatgccttgtatctcttgcagggtcagatttcctgtgatggcgatgatggtaaattcatttttttcctgactcatcaatacaaattccttttctttgtttttgttccgtttcagataaatgatggtcttttcgccttcatcgtttatgcgcatcagttcctcgtagccgttcttgggactgatgaaagctgtctcttttttcagcttggcgataatgtcgggtttttcacaacttagaatctggatgttatccagtttggaggctacttcgcctatatttaccccttccgttttcatgtcgggcatcaggctgagcatggcttttgagatatagacagaggttaccccgtccatatcagcgaacttgtcgaaaaaactgtcctgtgcgtaggtgaacagtgagcacagagagagcaataaggtaatgatatatgtacgtttcattgttttatgttatttaatcggtttaattgttcgtttacgttctcttgaatttttccggtggcttcctgcaccgattccactttttctattcctttattcaggctgctggaaagcatgataagtgccttctgggcctgtacgtatgcttcttcgggggtggcgcaggtatcttgcggtgccggatagggcttgtataggtacagtcctacggagagcaggatgagcaggctggcggctatgctccctatccattgcaagcggaggacccgtgtatgtttttttattttcagcgtgcgtctttcgcctgtgtcccattggtctatcttgcggctcagcctgctttccagtccttccggtatttcgggagcgggctgtgctgccagttgcatgaagatttccttctcggcaagtaaatgagccggaacgtcctcttcggtaaaaaagcgtttcagttccttttcttcggtttcgctggtttctccatcgtaataccgggtcaatagtctttctatttcatttactttcatagttcattattgcattatattgttcacgtatctttttgcgggcgcggctcagcaacacacgtatgttgatggcattcagtcctgtggcttgctctatctcctcaaaggagcagtcattgacatcacggagcagaatcacccgcttttgttgctctggcagtctgccgatgagccggcgtacctggttcacctcatcccgttgttccacttcccgcgctatgttggtgtccgtagggaggttcagctcttcgggtgcatgtccgtcttcatcgggccggctcctgcggagggcgtcgtagcacaggttcttgacaagggtgacgcagtaggcttcggtgttcagcacgcccgccagctcatcgcgcttgttccacaatttcagatacgcctcctgcaccatatcttccgcctcctgagggttttctgtcagccggaaggctgtccggtagagtttgcggtggtaaggcaggaattgttgtttaaactcagcggcgtccatgcttcttctttgtttcctgatttactaatttgtctatatcttcctttgtgaattttccgtttatctgtaccagtgtacaatcctcttttcccgtgcatacgaatagcagttcgcggatagtttcctttttggttttcatcagcacgcggactttctcgccttcatcgtttacacgcatcagctcatcgtatcccttcaggctcagcctgttcacttttttactgaaccgttcttttacgcttgccgtacaagattccaggtccagtacttttattgactttatttttcttattatttcagcgtcttcatcgtgtccggcgaacatttttccaagagacatcatgaaagaagatactttgacacaatcggcatttttttcgctgccgaattcattgaaaagaccgttgatgctttgggcgtagcccagatggcagacgaagactagcaatagagtaaatacaaactttttcatggttttattttgtttttgttcataactgaatttgttttttgaaagcgctttcaatcagatagacgggggaagcgggaaagttgttacaaagaggaaccgttttttttatgttattaatgcggggaggaggtatttttctcctcatggtatggggctgtctgtcacaataataaatcaaatgccctgacccttgttggcaggtgtcagggcatataccgtatctctgttcgtttatacagggttcgaagcgtcttcttctaataactcgctgataatgtttgccattttcttgttctgcaattggcggcagaattttacttcatatccatcaatctttaactgttggaagaaccgctctgcattatttatcttcgcgtcttcgactgttctcttggcttcatcatttggtatatctttagtttcaataacaatgttcagctcttttttgccatcggcacgttgcaccacatagatgaagtcggggctgtaaaggtcgttggtaatgttgggaatacagatactcttttgtggaattttgccatacactattacatggtcgacttcattcatgatattctccttttccagtggtgagtcgtataccactttgtcatacagatacttttttgaaggttctgcgtttagtacatttttgcctatcgtccactgcaacacctcttccttcagcgaaccgtcggcataggtaaaggctgttgattttgacgaatagtttgcctgacgatatttcaccaggttttgcaagttctttatcttccatccgttgaacttggcgataaatgcgctcagtgatgattcattgatatatccatccatcgggtgcgttctggcatattcacaaatggcggaatgcagcatagtcatcggtatgcttgtctgtcggcatgcacgcttcaggaactcgttatagtgcatctctttacctgccagaatgtattgctggccagcctgctgcatcgtcacaacttgaccatcggccgttgtcacttgctggcgcaggctttgtatggattggtgtataaaacatcatttattaaaataccgggtaatgctgctctaatctgctggtcaatgtcgttttggtaaaatacaatgtatttacggttgagttgcgcccacagttcttttagttcttcatagcgggctttgcgtattttcaccacatcctttgtacctttgttgcggtcttttaccttacctgtaacattgttaaactcaggatattcggtaaacaagtccatcacctttgttgggtcaagtgtgcgatccaagtcaagaacatattttttctgatacaattccatgaacagatccatttctcccgttccacgcagtgctgcaactcttcgcatatcttcaagggatatgtgtgtgatactacccgtctgtatatcctcatttatctccatcaccaaacggtctgcaaagtcgcgttcagtaaagtctacgatgtagttcaggtagaacgattcgtcttttacccggttgccatattcatccacaggcaggcgcaatcctcgtcccacttcctgtagtttgctgttttcgctgccactgctgcgcaatttggctattgtaaatacattcgggttatcccagccttcttttaatgtccacttcgagaagaggaaacggcgtgtattgggttgtcctttcttgtttacgaacgacaacagttcagttttgttgtgcaatatgtcatccacttccttcttcactgcatcgtccgggtcactgttgtcttgtgcgaagtagccggccctgcaagcggcaagatcattgaggcttgcacgcaagtatgttgcatatccgggcgaattttctttttgaagttctgttttcaattgtgcttcaagcagcctgtcgaacaaatctctcagccaggcattgttgccctcatcatctccgcggaaagagagtatgtcgtctataaagaataaagccagtgtcttaattctgcctttttctctatggaaattgtcacgttctgtttcaaaatgacgttgtatggcaaggcggagcatgctttcctgataggacgatgtgtatatgtccacatcaaactcgtcttttttgtgcttctccatgccgttgctgagtataaccaaatcttttgtgatacctgtaatggtgagccccgtgagttcgggacttaggattgacaacgaatctccgacactcaatacatgactggccttggaggtttgagtgatatgttggaaagtcgcttttttgtcattgatatccaatatctttaccttctcgttgatggttgaagtgggttcaaagtgctctttcattacccctttgatgagtcccgaagagaatgaacgttgtgcattaaggtcatagagcagatgctcataatcgcgtactgttgttttctttttccctttgcctatggtagtcatcgggaaggttgcaccaaagcggatgatgcattgcggagtcagttcgctgatgatggctttatatgccttctggtcacgcgagaaagtgtgaggctcgtcaatgattacgaatggacgtgtggaacgcagtgcgtcaaacggccggtcgtatccttcgatagtcacatcatagtcattgcgtgtgagcatcttgccggtagtgagcaaagcactgttcactatcagcacatatatcttgtttctgttcagtcttgatccttccacgaaggcacgcactgcggtaggaaaatatttcctgcctttcttctgttttttcacagcttccagcacacccacgtttatctccgcatcatagcccaacgtgtttttaaaatgtgctttgacatacgtttcgttcagaaaagtgcttgtgccggctttgatggcaatgcttggaacggcaatgatgaacttgtttatgccataacgtttgtgcagttcaaagatggtgtgtgtatatacgtatgtcttgcctgtgcctgtttccatcttgatgtccagacacaaggtgttgcccaccggctgctcgtttctgtatttttccgccacattctgccgctccctttgctgtatgcggtatatatttccaataaaacggtttgaacgaaggtctataacagggtttgagtaatgtgccacctgttgatttatctccacctgcttgaacacctcgctgatggcttctaccgcatactcctggtgcggcaatccgctttctaatttcagttccataatttgcaggtggttttagtagcgaatatctatatttatgcggctgcggtcggtgatggcacccaaatttttctttatggcgtccgtctggccgaagttaaaactataaccgaagataacgacggtatcggctgtgaacgaatggtctttgttgtatttatcaaccagctctgtcaaatcatctcccagtatatcaaacccttggtctatcatatagagatgtttgccgcagagccaagctgtatagttgccaaactttaccggttctattttcggtgtcagtccgtaaccgtcgcgcacggcgtatgtggcaagaaccgtttctttaccgaaagctttcactaaatcattgccaaaagcatcagtcggaacaaacttttccatgcggtcaagcgtgttttcgtccggctcctggagtgtgtagtgcttgaagccataatctatatcggcatggttttccgactttatcttggctgctgcacggcggatacgctcttggccgatttggtcgatagtcttatacttctctttgtatgcctctgtgtttggttttattttttcgggcaattgtacaaggatgtactgtaagttataaccatcttccacactgtttagttccattacggcttgtgcggtggtgcccgagccggagaaaaagtcgagtatgatgatcggttcatctttgtccttttctacagctccatctataaggtgttttatgagacttacaggttttggaaaactgaaaatcttggcattgaaaagctcgtctaaatcctttgttccgtcttggctcatgccgatatgggatggaagatgagtgctgacggcatattgtccgaagcggtcaccagccttttgcatatcattgtctttccaatagcggagcacgggcttatctatttttaggaaatcgtaatcaccggggaatacgattcttttttgtgcataataagaatcaaatgtgtcctgtgtaatgcaccaagtacgtttcgggtttgctggatattctttaccgttttgagggttccttattgtgaaaaaactgttggggcgttccgatgcagtagtctgctttgtcaaatcatgcactctccaaggttgtccgggaaaatcttctgtttcgtaatattttcttccctttccatcgataccagccaaaaaagaatctgttctggcgtatgatactatccattcgtaatcttttgatactccgaatggaacatctgactttgccgttcttttccgccatgggaatagagccacaaaattttcctctccaaacacatggtcgcacagcaacttcaagttagcctgctcattatcgtcgatagagataaaaatcactccatcgtcagagagcaagtctttagcgtattgcagacggggcatcatgaaggtaagccatgctgagtgcgaagcagcaccacgggttgtcattgcaagaatacggtttgcttgttcctcaccgatgctcaatttctcttgcaattcttccactgtaaagttgaatttgtcattatatacaaatccgtcagtacctgtattatagggtggatctatataaatgcatttcactctaccggcatacgactttaccagatgcttcagcgcgtcaagattgtcgccgctgatatacacattctgactatttatattctccggcttgctgttatgttccagatcgggcactaatacggtagtcgtatccatcgaggccaacagactggcatagttcttgccaagaaagttaaagccgctaccttcctttataaggtctactttgtcagttagtagctcacgaaaagcagctatatcaaatttgccttctgcattgaaacattgcggaaagtcccggtgtagcaatcctaacgttctgtcagtaggttgcgcttcttcattttgatttataatatctcgtatcataatttttatcttttctctgttcggattttagcgatttgataattgaatgcttggtgtcagatagaatcttatatttgtttgatgtttaatgtttgttcttttaatgatgtcttagttgctggttcttcttaagaacaattcgacattttattatgaaaaataatcctaaaatccaattacaaaagtagtgataagtttgagataatgaaaagacgttcaggtaaaaatatgaatttagttcgaataaggttagtcaggcaatgcctcagcttgggagctaagtgctttattggttccgcacaggcagcctcacccatagccatccgggaatcagtttccagaaaaacaccagcatctgataacgccggtctatgacagctactcttttccttcgggagatggctcttacaatttgtgatgccacgtagggagcatgcatcagcagcgggtatttgtcatctttcaacagaggggtggcgacaaatccgggacggatgtcggtgaaggaaatgtgtagcttgttcatgtgcgccaattggtccaaagcatccagataggtgttttgaaaccgtttggtcgctgaataggcaggggcggatcccagtcccttggtgcctgctatggaactgatcaccgctatatgtcctttgccttgctgttcgaaatagtgataggcggcattgaccatccgtatgaatcccgaaacattggtggctgcggtctgtaattcgatatcggggcagagtgaaagattttgtttgcctatgcccgagctgagcaagaacacatccatacctcccattttagtaatcagttgctccaatgagaaaggggcgtcctcacgggtgacatctattgtctgagtacatacctgtccgggcgcggataaccggattttttccagttcttcttctctacgtcctgccacgcctacttgccagccgtctttcagatagcatcgcgccacttccagtccgatgccggaagtggcgccaatgataatgatttttttcatccgcttcgtcttattgtaaagcttgctcaatgtcggctatgatgtcgtttacattctcgatgcccactgaaagacgaatcaagtccggagctactcccgcttcgcgcaactgttcgtcggtgagctggcggtgagtatggctggcgggatgcagtacgcaggtccgtgcgtcggccacatgggttacgatgcagatgaatttcagcctgtccataaattctatcgcttcctcacgggttccgttcaagccgaaagcgatgacaccgcacgagccgtttggcatatatttctgtgccagatcatagtatttgctgcttttcagtccgcaatagttcacccatttcactttcgggttggcttccagccattcggccactttctgtgcgttttcgcaatgacggggcacgcgcaggtgtaatgtttccaatcccagattcagcaggaacgcattttgcggagactggatggagccgaggtcacgcatcagttgggcggttgctttcgtcatgtaagccattttgccgaacgctttggtataagtcagtccgtgataagactcgtcgggctgggtcagaccggggaatttgtccgcatgggcttcccagtcaaagttgccgctgtccacaatggcgcctcctacactggtggcatgaccgtccatgtatttggttgtagaatgggtgacgatatccgctccccattcaaacgggcggcagttgatgggagtggcgaaggtgttgtccacaatcaaaggcacaccgtgcttgtgtgcgatgcgtgcgaacttttcgatgtccagcacatcgatgctcggattggagatggtttcgccgaacaacgctttggtattcgggcggaaagcttggtctatttcctcttcggatgcattggcgtcaatgaaggtacactcgatgcccagttttttcagcgtgacgccaaacagattgaatgtacctccgtagatggtagacgagcatacgaagtggtcgcctgcctgacagatattgaaaatggcatagaagttggcagcctggccggacgaggtcagcatagcacccacaccaccttccaatgctgcgatttttgcggcgacggcgtcattggtggggttttgcaagcgtgtatagaaatatcccgaatcttccagatcgaacagacgcgccatctgttcgctggtgtcatacttgaatgtggtactttgataaataggcaaaacgcgcggttcgccttttttcggagtccagcctgcctgtacgcataaggtctccctgctatacttcttatccatgtttatattgttattaaaattacatattcatttatttcgcagcaaaattaagaataatctgtcatttagggttcaattattgagaaaagtgttatatttgaacgattttaataagcttaactatggcagaggatataaaattcaggcatactatgccggtgcagatacgattcagcgatgtggaccagtttggtcatatgaacaattcggtttacttttctttgtatgatttggcaaagactacttatataaaagatgtgtttggcagtgccgactggagtaagctggctattgtggtggccaatatcaatgcaaacttctttatgccggtatttttctcggatcatctggtgatagaaacggctgtggtacatttggggcataagagttttactttgttgcagcgtgccgtgactacggatacccatgaggtgaagtgtgagtgccgcacggtgatggtaggttatgacctggctaccaaagaaccgaaattgatttccgaggattataaggaggcaatttgcaggtacgaggaaaaaacattggaggaactttcaaaagggtagaaatggatggtatactcgctataaatagctaaaaaattatttatagcaagattgtattattttattaaaagtattctcctgtaatggttaaaagtttgggagatgagtcaaaattaccatataataaaatttctctttgaaactttcctatgtcatcgggatggaaaatgatattcagacaagtgctgtctcccggatttatttcagtaatttcattttcaatattcaaacattcgcatgaaagatctatatgactgattcttactatgttcttccctgtattccatattgtgaatttgattcttgccttttccgtgcggctgattttgcctaaatctatctcatttgtgttgaatgtaatggtggtgttcgcttcttcgctgggagattcatttccataaaaagagtgcgacacatatttaccattatttaaaaggtagactctaggtgtgtttttagccatatccaattccactaatatggatttagtgtctagatatacattggagtagtcatctgtatttttattgacaattaaattgaaagtctttttacttttacatgcaattatataaatagtatcggtcgagttatgtatttctgacagagctttgtgtatgcatcctttgcaaccattacccaatatggtaacaaggtgggtggcattgtggatttgtgatttctcaactccgacttcatcaaacagtttttgaaggcatttgtcattattggacatacagcttgccaggaacagtcctccacatagaatgattgagtagttctttttcttcatttttttcggccttgaagtgtgaaacacctgaataccagtttgttttcgtcaaactgaggattgttttcattattctctgaaatatacaggccttttttacctacgaagcacaagtgatgggcataggtgttgccgggaaattttgtttcaccaataatttcataatctttgtttagaatgatgatggagaaactttgatgcggattgttggagaatggttttatattatcatccggcattaaggcaaaccgatagaatacttttcggtatttatcatacatcaagtggtggtaatggggctgtaatcctctgtcatgtatggttttgaataaatcaatttgtaaattttgggagactggacgcacgtggggcagataatggcttttagcattatacgcttttttatgtttgaaatcagaagatacaaatatgctgtcatattgtcccagtgaaacaacaacttctttacctgtatatgtgtaactgatttcagggtcatacagaatgtagtctatctcatctttgttaaaaatagatgggtatcgtagttctgtccaccctagtttttttttatgaaggtctgcataagcaaatatgggtattttatcccattcatcttttttacggggatattttaataatgattgactgaaatataaaatagaatccttaattatggcaggtcgatatgtataactcatgcaacaaatgtggtcgaaagcatgaaagtttacgctgtctttccaaaagctattcttattttccacttctcctttttcattgataattccaaaaactccattccaagttgtaattaaaaaatgctttgagctaagtggaaaacagccattagttgatggcattgcatttctcccctctttttgtagatgaattgttttaataacttgtttggtatccaaatcatagatatgaactttatagcttgctttttcattcaaaaaggaaagatactcatgtccgttttcttcaaattggaatatagatttgctttcataatgtgtatgttcatctatagacaggcagatggagtctgtagctgttaattctgtaccatagtctattggacgagaaggagatgaacatgatgctcctagaagcagataagtgaagatatacaaaaaatatttcatacactatagattaaatatagggtatttaattatcttcagtttgtagattggatcaactaattatgaataggaaagatcttaaataccctatggaatgatttgctagtcggttaaattaattgggagctccttcatctcttccgcacctttggtttgggtcttcataacaattattgaatgaaaaatttacacaagaagacgctccatcgaaataccagcatttatctccttcaccgggaggtccgtaatcactgcgagcatttccgttttctgtgttgctcggaagaggtgcatcaaactttaattcttgtcgggaagaatagatctctacgctagtcaaacaaagaatgactaggactaaaaaaagtgatttgtttttcataagatctgcttttaaaggttagtatatagttaacttcacaaatgtacattagaattttattatatcaaatatattttggaatatttttcagaatatattgttgggtaactggtttatatgcagtgatataattgaatgtgacttatatgatgtgctaaatttatgctttttattatgaagaaaataaacctatttagttctaaaactattaataaagttctttatgtaccaactcttcaaacagcaatgcatattttgcaacgactgcttcggcgtatttcttcccttttccggcacttgcttttttgggattgcctataccggtgtcttgcgaaactttttgccagttcctcggaatccatgccactttttcattcaacatttgtgaggtgaacttcttataatctccgtttccggcttcgtctaaatttaccaattccggatgataatgcatcataacagaagtttccaattcatctgcatggtcacccggttcatcaaagtactctttagcaggaacaaaggcaaaccattcgctgctggctatcaggaagtcgggatagtccagtgacaagtcacgtattatacttttgaatgtattgccgccatgtccgttgataatgaccattttgcggtatccctgggcgtatagagaggcaactaggtcgcttaaaatcgctttttgcgtttcatagcgataatggatgcagaaatccagctcgcgttgtcccggattctgtgaaccggcagtgacgtaaggcatgaccatgcaacgaataccgtaatgtgtttttgccagttttgcagcatctagtgcgatgtcgtggctcagaatgcagtctgtcagataaggcaggtgcagattatgcggttcggtagctccccaagggaggaggaccaaatcatatttcaatggttttaccttgccgtaacaggttacggcaaggtctagttctttatccattatttataagaatttttaaagatatgcaggatttcttcgtctgtaatcgggcgtgggtcgagagtgaacagtcctcccatcgtatctcttgcattttgcaggaatttggggaaatcttcggattggataccaaattcgctcagtttgatagaatgtactttacattctttttgcagtgtaatcaatgcatcaatgaaatcggacggacggttgctctttttctgggtcatcatttcagccattttcatgtaacgttttgtacagtcatgccggaaagtttcgaagtatgcctcagacaaggcaatgagtcctgctccatgaggaagttgtggataataagcactcatggcatgttctaatgaatgttcggaagtgcagcttgaagtggcttccaccatgcctgccaaggtgctggcccaagcaattttggcacgcgctttcaaattctttccgtcggctacggctactggcagatatttgtagatcagacggatggcttctaaggcgtaaagatcactgatgggtgttgcacaattggcgataaaaccctctgcggcatggaagaatgcatcgaacccttgataggcggtgaggtgcggaggaatggaaaccatcagttccgggtctacaatagataaggtagggaaggtcagctggcaaccgaagcctatcttttcttgagccgtttcgtgggtaatcactgtccatggatccatttctgttccggttccggcggtggtagggatggcgataatgggaagtgctttggtaacaggacgtcctttgccactaccccctgatacataatcccagtagtcaccgtcgttgcaggccataacagctatacttttggctgagtcgatggaacttccgcctcccagtcctactacaaagtcgcacttttcctcccggcagatggcggctgcttccatgacgtgttctttgatggggttgggaaggattttatcgtaaaccagtgtttctacattattcagtcttaattgggcaagtactctctccaagtatccatatttccgcatggaagttccggatgagatgacgaccagtgccttttttcccggtaatttttcactggataatttcttgatttctccgcaaccaaatactaatttggtagggatgtataaactaaatacaggatttgctttcatgttctttcgtatttaaagtttcactggtaacaaatgtaggaaaataatagtttgcttgtttaagtaatttgttaaattttacatactgccggattgtattcgttttctttaattcagtttgagatagatacgttttttcgattatactcgaaaaaagaaataaacagtgcttttttttcgattatactcgaaaaaaactatctttgtgggaaaagattcgagtatggacgataaatggaacgctttagaaaagtataacctttggggtggaaatacgtatcaattgggactggaacggaaatcttataccgacaagattggcaattttgtggggtcgttatgtagaatttcatatattcccctatagttatgctgaatatttacagttgatgcagcaacctgccggtcgggcttcttatttggcctatttacagaaaggcggtttgcccgaattgtacaacctgcccactgtcgagtcagaaaaacagtatgtcgcttctgtgaaagatacgattttgttgcgtgatatagtgaagcgtaaacccgttcgtgatgtaaggttattggatgatatttttatttatttggtgaataatgcgtccaatctgttttccgttcagcatattgttaatttctttaaatccaagaaccggaaggtgagttatgataccttatctaattatctaggttatatagaagaagcttttcttgcttataaaacagaacgttacaatataaaaggaaaggatgtggtggcaggtaattgcaagtattatctgaatgacttgtcctttaagaattttctttatccgggctttgcttatggagtcgggtatttgttggagaatgcagtatatttggaacttcgtcgtttaggctatattgtatatacaggttcttttcgggataaagaagttgattttgttgctatgaaggacgatagagtgatttatctccaagcaacttacatgttggaaacggcacaaaccatggaacgggaatatgctcctttgctgacgataggtgataattatgaaaaatatgtcgtttccatggatgaggtacaattcccttccaatgaaggggtcaggcatatacaggcttggaatttaaaggaaatattgtaggaaatcagtttctctttttaacatacagtttttggtaagagttgtcaaaactctgatgatattgtttgtagtctattatccaatgttgctcaccgctcccccggatatgtagagcaggaatagcaccgaagaggagagtatagtggatattatttgcttatgtgcagttggcgcaaacatacgattggcatatcagtctgtatatcagtattccgcttatctttgcagtcgctatcgggctgagtctgctttcttattactattttgagaaaccggccaaccgctgggtaaaacgaattttaaataaacaataataactagttcatggaaaaacaattatcagaaaaactgccacgcgttgaggtggtggatgctttacggggatttgcagtcatggcaattcttttagtgcatagtttggagcatttcatctttccggtttatccggtagaccagcctgcatggttgaatatactgaatgacggggtattcaatgttacatttactttattggctggaaaatcgtatgccatttttgctttgctgtttggatttacattttatattcagtcggctaaccaacagcgtaaaggaaaagattttggttatcgttttctgtggcgtttgctgttattggtagcttttgctacgctgaatgcagctttttttccggcaggagatgtgttgttgctgttctcggtagtgggaatcgtattgttcgtggtgcgcaagtggagtgactgtgccatacttgttacggctattttgtttttattgcagcccgttgagtggtatcattatatagtaggtctgtttgatccttctcatactttgcccgattggggagtggggcgatgtataaagaagtggcggaatataccaaagaggggaatttgtgggagtttttgggtaagaatatgacctttggtcagaaagccagtctatattgggctctgggagcagggcgtttttggcagactgccggcttgttcttgatggggttgtatatcggacgcaaacaattatttgtaacttccgaaaaacatactcgtttttgggtgaaggctcttatcatttccgctatctcttttgctccgcttttccaactgaaagagttgattatggctagtgacagtgaactcattcgccagactgccggaactgcttttgatatgtggcaaaagttcgcttttacatttgtactggttgcttcttttgtattgctttatcaacgggataggttcaagaattttgtatcaaatcttcgttattatggtaggatgagtctaactaattatatcacccaatctattgccggagctattatttatttccctttcggactttatctggctccgtactgtggatatacgttgagtttgctggttggttttgtactctttttgttgcaagtacagttctgcaaatggtggttgaaaggacataagcagggaccgttagagagtctttggcataaatggacctggatgtattccaaaaaataaggaactctgggcaggagttgcatatgctatacggaagagaggaaaaggcgaaaagtaatttgtcttttcctctcttccgtatagggactgattcttgttttccaagtttcccgaatatcataaaaaggatatcagttcaggattataatcaattgtttttgccttctatctgaatttgaattgcttgtcctgtacgttgcagacattctataaaaatagaaagatgattggtcttttgcatcaactcacatataatttccttttcttctgtgcaccaaggttcataagcacgtgggaaagtttcacgttgtttatggatataaggtggaaggactgttttctgaatgcctaactcttggactttttgttttatacggcaaatatcttcttctgtacaatcattaaaagattcttttgtaaagaaccccggatatttttggtcaatgtcaagattgattgtaggcttagatagggattgaaaggttttttctctgctttctagttcctttatcagattgttgatgtactcatcggcttgaacagatgatacaactatggaacattcgtggcgggagtattctttatggcggttggcggataaccagttgaaagaaccctctataagtgtatggttatcaatggccaatgatttattgtggataccttttacttcaatgagggttgcgccattttctattaatatgttccgtccctcttcggcacggctgagcaactgattggttttcgtatcataatctagagacgaatcggtgtagactgtgacatccactcctcgttgtaccgtgtggcgtatcagcggaaccaactggtcgttttctatggcgtggatagatatgaatggagatacaatcagcagacggtgtcttgctttttcaaaagcttggtgcagaacctggatatgctcttctgtggtggacagacgaagggtggggtggtaggtgcacagcggaacttcctgttggtaaataaagttgttggaaatctcgttggatggatcatcgaaaagccatttagccatatttcctaccggggtgttttcttccggatggaaaatattcatgttgccaaaaacaatgaaatgatgctgagcgcgcgatatcgctacattgagcatattgtattttccatcacgctccataaaaagagaatggtcttcgggagagttgactgttgaaaaaagaacaatcggacattgggcaccttgcagggaatgtactgtgccgatgatcatatctttatatttctcatttcctgatattttttgtatttgatgccgtatttcggcttcttgggctttaaaaggagttactacggctacaatttcatgaataggctttttataggtcttttccagattatctttttccagttccagccaacagacaatggcttccgcttcagcccggttgaggcgacttcctgtttttccagggctgctgtaactgttgatgtgtacatatcctttggaagggagggacttgtattttacttcgttaccttttttaggaagtaacctgccgtggtaaacataatcattgcaataggcaataatggaatctacgcatcgtctgtgttcggtcagaaaagctcctttttcaccttttactgtaaaattacagcttttacgtgccagtttcattatacttccggaagaagaaaggaaaccattgttttctaaaaaacggtatttttccgaggactggttggaaacaatgcccagattctttaaattaatgaatgaatattcatcagaaatggaccatacaggctctatttgttgaatatcacctactaaaatcgcttgcttggccaaactgaaggagggaacggcaagttcgggtgaaacttgtccggattcatctacaatcaacagatctattccattgtataaaggaatatcccattttccgttctccgcataggtcatatacttgggtagagaatggaaagtagagatgaaaacaggcattacgcaagccaaacgttttaatctttgggtataggcttcttgtgtgcgctgcttgccttcatcgcacttgcttaaccggtgaataaactcggcttcccgataatgtatggcataccagaacatttgataccgatagctgatatccagccttactgccatgtcttctgtataaggcaagttgccatactcagggttggaacttattttttcgtaacgttctttgaattcttctgtcaaagtccactgttctattactttgtcataggagggtaatggctcatggaatttgcggataaacttctgtaatatattgttttccttccggtttccgtattctgttgtttcggcagcttggatacagagaataatctttttttggagggcttgcatttctttacggagaaattgccggcattttgtttcgtcttgatagtttttcttgaaaaagttattgaagcattgcagatagaattgtttgtactcttcttgacgttcaggtgtatcgtatgctgccggaaatccatcccctttggggttgaacatcattttgtactgttgttgcagctcttttttccctgacagatataggcctaatgtatccagttcgggtagccagcggttggacaaccggggatgtgttgtgtcattggttgtttccgctttgaaatcctttaggatattggtgatcgcctgattattagctgaacttgcaactataatttccggctcttccggattgtttagaatgttatgagcaagtctgtttgcgatgacagtttgcagaaaagtggtttttcctgttcccggaggaccgttgacgacaaaaatatcagcacattccggtgttgtgtacattgctagtgtttcgcgttgagatatggacaaaggaaagtcgctgctcatttgtgcccagtgttcttggttgcaatatactttccggttagttggaataggaagagcgttagcagattttgtttgtattaataaattcaacaggggatgtggagtggtattgtcatcttttaagagtttgtcatatagtgtgattatgggctgtgccatattgcgctcggaggcttttatgataatgatttctggattatcatagtaattcattgtgctgaaagttttgccggttgctttcttgaaaagctgctcgcatgcttgccaataggcctcccattttgtttcttcagtgttaaaattggatagtagttgatctacttttgaaagagaagctatagtgcggtcattggctgcattaggctccaaaaatttacgaataaatattgggattctgtctgattcgttctcgcatacggttagtttgccgtcaggcaacatggtggcagtaatcaagaagggatattccggtctttctgattgggaagtccagccgttttcaaattcgggcaaaagaatacaaggagcaatcattactttttgtttttcattgctgtcttctgctttccaatcagggaaaataacaggaatacttttgagaggaatgaatttaagtatcttgtcatcaatgtttagggtgattcgtggtcctttgagagcaatagctttgcgctctgcatcttgaagacaagttttccagtattttagtaaggtctggtccatttgtttttacgtttgtgtgatggaataatttacaaatataagaaaataggtgaaaagaatacggtaattggagtaacattcctgaatttatgatttttttacattaagagggattggagatgtcgggataatcattattagcggtaaatgaattgggatgaacggaataatggtaatatttagtggtgatgaggcaagaaacttgcctttatgaagcaaatgaagctaaaatagacgagaatttatctgtgtggggagtgtggatatactaattttgccaataaatgaaacttaaatctatgatgaaaagatttgcaaatttattggctgtttttattctttctgtaaattgtattagtgcccaaaatctaactcgttgggttaatccgtttattggaaccggtgctgttcaatccagtctttctgggaataattatccaggagctactgtcccttttggtatggtgcagctgagtcccgatactcgtgaagcgcctgattgggcacaagcttcgggatatgattataatgattctattatttatggtttcagtcatacacgtttaagcggaaccggtgcttccgattttatagatatccttctatttcctaccatgagtgataaaaggaaatcgtcttttactcatcaaaacgaacaggcgcgtccggggtattatcaagtattattaacggatgagaagattcaagcggagttgacggcttctgtgcatgtaggggtacatcgctatatctattctgatggcggtcagttgaaattatggttggatttagatcattcggcaaataaggagagttggaaccgccggataattcaatcacaaatccgtgtagtttctcctacagtagtagaaggatatcgtgttattacaggatgggcaaaactgaggaaaatatatttccatcttgaattttcccaaccaatcttatccagtcagttacatgatggcaatcggaggtatgagaatactcctgtcattaatggtacagaactgtgtggattattctgtttcgacaagaagtggaataatgaattgatatgtaaagtcgctttatcttcagtttccattgaaaatgcccggttgaatatggcagctgaggttcccggatggaactttgaacatattgcttttgctgccgaagccagctaggagaaagaattgaagaaagtcatcatccaaggtaccggtttgcagaaaaagattttttatacagctttatatcacactatggtacaacctaatacgatgagcgatgtaaatggtgaatatatggctgccgattatacgacacgtaaggtagccgataatgaagttcattattccactttttctttatgggatacattcagagcagctcatccgctttatactttgctgcataccgaccgcattcctgattttattaaaagcatgatgaggcaatatgactattatggttatttgcctgtatggcaattatgggggcaggataattattgtatgattggtaatcactccattcctgtcattgtggatgctgtgctgaaaggtgttgcaggagtggatgcggaaaaggcttatgaagcggttcatagcagttccatcgtatctcatccgaactctccttttgaagtatgggagaaatatggatacatgcctgaggatattcaaacacaatctgtttctattactttagaacaagcttttgatgattggtgtgttgcactgttggcccggaaattagggaaagaggaggattatgggcgttttatgaagcgttctgctttttacaggaatttatttaatgcagaaacaaaattctttcaaccgaaaaataagaaaggagaatggatggagcctttcgatccttataagtatggagccaatggcggctaccctttcactgaggggaatgcctggcaatacttctggtatgtaccccagaatatacctgacttgatttcactgacagggggaaacaaagcttttacggcaaagttggatacctttttcacagtcaatcaccaaagtggtgaactgaatgacaatgcttccgattttgtagggcaatatgcgcatggcaatgagccgagccatcatgtggcttatctgtatgcgtgtgcgggagaaccttggaaaacacaaaaatatgtggcacatatcatgaatgaactgtataatgattcctcttcaggttatgccggtaatgatgattgcggggaaatgtctgcctggtatgtgtttggcgcacttggcttttatccggtaaatccggttagcgggaagtatattatcggtactcctatgttggaggaagcggttattcagttgcctgatggaaagacttttaccattaaggccccacgcaaagagcacaatgagatttatatccgctccatgaaactgaatggcaagaaatatacaaagaattatattactcatcaggatattatgaatggcggaacgttggagtttgtaatgactgcctcaccgggaaaatgataacaaatggtgaagtattggaatttgtgccgggaaagatttctaaatgttgaataactcccttttataggttacgattgaagcaaaagagtctaaaaatggcgagtttttctctacctaatgggagaggtatatctacttttgtttcagaagaaactattaatcatgaaaaatatgaaacattttaagacttatttagcagcaatggctttggccctttccggatgccagagtgcaacagattcctgtggaactacagaattgtggtatgcccaaccggcaaaagtttggatggaatctttacctatcggtaatgggcgtttgggagctatgacttatggtggaatagaggaagagaaactggcattgaatgaatcgacaatgtggtccggccagtacaatgagaaccagaacaaacctttcgggcgagagaaaatgaaccagctcagaaagttgttctttgagggaaaactatcggaaggaaaccgtatagccggagataatcttcatggcaaccagacttctttcggaactcatcttcccattggagatttgaagatgcaattcatttaccccgaaggtaaagtaaccggctaccgccgttcgttaagcttggatgaggctatcagcagcgtttctttcaactccggcggtgtgaactataaacgtgagtattttgctacaaacccggataatgttctcgtactccgcttgaccgctgataagcaaaagtccattactatgaatatgggattggatttgatgcgtcaagccgatctttctgtagaagataaccaattggtatttaccgggaaagtagattttcccttgcatggtccgggcggagtctgttttgaaggaagaatagccgttttggctgataatggagaggtaaagatggaacagtctggagtaggtataaaagaagctgatgccgtgactttgattgttgatgtgcgtaccgattataaaagtcctgattacaagaagctttgtgctgatggcgtgaagaaggctatagctaaatcttatgatgaattgaagcaggcgcatataaaggattataacacgttgtataatcgtgtttctattcatttcgggcaggacgctaaccgcgcgttgcctacggatgttcgttggaaacaagtgaaggaaggcaagactgatactggtttggatgccttgttcttccagtatggccgttacctcaccattgccagttctcgtgaaaactctccattgcccattgccttgcagggtttcttcaatgacaacaaggcgtgcaacatgggctggaccaatgactatcatctggatatcaatacagaacagaattattgggcagccaatgtcggcaatcttgccgaatgtaatgcccccctgtttacctatattaaggatttggcgcatcacggtgcaaagactgccgaagtggtctatggatgtaaaggttggactgcccataccaccgctaatgtttggggatatactcctgcatccagcacgattatttggggactgtttcctatggcaggctcatggattgcttctcatctttggacacaatacgaatttacacaggacaagcaatatctggccgaaactgcctatccgcttttgaaaggtaatgcacagttcattttggatttcttggcaaaagacccgaagagtggttatctgatgacagggccgagcatctcacccgaaaactggttccgtacagtaggcggtgaagaaatggttgcctccatgatgcctgcctgtgaccgtgaactggcctacgagatcttgtcgaattgtgttcaggcttcagaaatattagataccgaccgcgagtttgccgatagcctgcgtaccgctattgtccaacttcctcccatccagttgcgtgccaatggcgctatccgcgagtggtttgaagatttcgaagaagcacatcccaaccatcgccacacctctcatctgctggctttgtatcctttctctcagattactttggagaagactcctgaactggcggaagctgcccgcaagaccattgaaaatcgcttgtctgccgagaactgggaagatacagagtggagtcgtgctaatatgatttgtatgtatgcccggttgaaagatgcgcaggaagcgtataagagcgtccaattattacaaggtaagctttcacgtgaaaatttaatgactgtatctccaggtggcattgctggggcggaaggtgatatttattcgtttgatgggaatcctgccggtacagctggtatggcagaaatgctaatacagaatcatgagggttatgtagaattcttaccttgtttgcctattgaatggaaagatggtggttttaaaggtctatgtttaaagggaggagctgaagcgactgctgagtggacgaatgctgtcattaataaagcttctttaaaagctactgctgatcaggttttaaaagtgaaaattcctcaagggaaaaaatatagagtgcttttaaatagtaaggaggcaattgcaaatcctgatgcaaaaggtttgataacggtggatatgaaacgtggagatttgctggaattgttgtaaaaaatagattgctttgcatagcttgattgaggattacatctcagtatattgaggtgtagtccttgttttatgataaagtaacttgcaaaataaaaatagtaatattgtccatgtcccaagtaattttttctatttcttaaacccttgaatctttgttactttgcattataaaaaataactaatagttgataaccatgaaaacacaatctaatttttatctattccttattgctttgatttccgctatgggaggtttcctgtttggatatgactgggtcgtaatcggaggagccaaacctttctatgaacaatatttcggtatagccggtaatcccgtcatgcagggttgggctatgagcagtgccttgattggctgtttgtttggggcgctaagtgccggcaaactgagtgaccgtctggggcgcaaacctattttgattctggcggcaggattatttatttgtacggctgttggtacgggggctgtccattcctttactttatttaatgtatttcgtctgataggaggttttgctatcggtatcgcttccagtttgtcacctatgtatatagcagaaatagctccggcgcatctgcgcggacggtttgtatctatcaatcaattgacggtagtgttaggtatcttgacttctcagattgttaattggcagatagccgagcctgtggcattaggagctactcatgaaatgatccgtgaatcatggaacggacagatgggatggcgctggatgttttgggcaatgactgtcccggccgccttgttctttgtttttagttttatattaccggagagtcctcgttggttagccttttcgggaaagcgggaggctgcactcaaggtgtttacccgtatgggaggaaaggaatatgctgttactgagttggcggccatagaagcggcttcagcctgtcagacgcaagaaggaggttttcgtcaattattgaatcctgctatgtataaagtgctgactataggtgttgtcatggctattttgcagcaatggtgtggtattaatgttattttcaactatgcacaggaaatatttatggcggcaggttatggcgtgtctgatgtcttgatgaatattgtggtgaccggtattacaaatgtcatatttactattctagccatgtttgtggtagaccgttggggacgtaaggcgttgacactgatcggatcatttggactggcagtaatttatgcctttatgggagccgcttattattttcatatcacaggagttgtgctgttgattattgttgtgatggctattgcctgttatgccatgactttggctacagtgatgtgggtcattatctctgagattttcccgaaccgtattcgtggagttgccatgtctgtttgcactttcgctttgtgggcggcctgctttatactgacctatactttcccgatgttgaatagtggtttgggagctgccgggacattctggctgtatgggctgatttgcctgagtgggggaatatttgttgtattccgtttgccggagaccaaaggaaagagtctggaggaaatagaaaaagaattagtgaaataacaatcatttattatggaaaaaataactcaatatttaattcaaagtaccgttcatggcagtgaggtgcgtgcatgggaggaagatattatgcttcctacttatgagataggagaggaagagaagaatcctatttttcttgaaaagagagtttatcagggaagttgtggagctgtttatccttatccggtagtcgagaagatttcagataagaaagcagacaagaaatatcatgcgttgtttatcgagaatgaatacatcaaggtgatggtgcttcccgagttgggaggacgtatacacatggcttatgataaggtgaagaaacgtcactttgtttattacaaccaagttgtgaaaccggcattggtgggactgacaggaccttggatttctggaggaatcgaatttaactggcctcagcatcaccgtccttctacttttttgcctactgatttcttgatagaggaaaatgcggatggcagcaagacaatatggtgcaatgaagtggagagaatgtttcgtactaaaggtatgcagggatttacgctttatccgggcaaggcttatatagaaattaaagtgaagatttataatcgtacgtctttccctcagactttcttgtggtgggccaaccctgcagtggtggtcaatgaccattatcattcggtattcccgcctgatgtgaatgcggtgttcgatcacggcaagcgcgatgtctcttctttccctattgctacaggagtttattataaacaagattattctgctggtgtggatatctctaaatataagaatattccggttcctacatcatatatggctatcaagtctaaatatgattttgtgggtggctatgaagaagatgttcgtgggggacttctgcacgtggccgatcatcatgtttctccgggaaagaaacaatggacatggggaaatggtgatttcggtaaggcttgggatcgtaatctgactgatgaggacggaccttatattgagctgatgaccggtatgtatacggataaccaaccggactttacttggttacagccctatgaggaaaaatcatgggtacagtattttatgccttatagtgaagtgggttatgtaaagaatgcaaccaaagatgctttgttgaatttggaaataaaggaaggtaaagcccgtttggtgctttatactacgggagcgaatagtggagtacgtattatagtaaaagctattaaaggcactgtattattggataagactacacaaatttcgccatcagaaccgtttattacgacttttgcggcagaaggactaaaagaagaggaggtatgtgcagaggttcgtgataaggaaggacaaattttgctttcttatcaggcggataaaccggaaatcaggccggttcctgatcctgctaaggctgctaaagatcctcagaatattgcttctgttgaacaactgtttttgaccggactacacttggaacaatatcgccatgctacttataatccgatggattattatatggaagcattaaggcgtgaaccgggagatgtacgttgtaacaatgcggtggggttattgttgatgcgtaaaggacaatttgcaatggcagaaagctatttccggaaagcggtggaaaccttgactgaacgtaatccgaatccttatgacggtgaaccttattataatttgggctggagttgtatgatgcaacagaagtgggatgaggcttatgatgctttctttaagtcggcatggaatgctgcttggcaggatgcggcttattatgcactagcacaacttgacactcgtaaaggaaagtatgaaagtgctttggacaagatagaccgttcattgattcgtaattggcataatcacaaagcgcgtcagttgaaaacttccattctacgcaaattgggtcgtaaagaggaagctttggcgctcgtagctgaatcattgcagatagatcgttttaatatgggatgccgttttgaacattatttgttgacccgggatgtgaaagtgttggaggaaatgaaagagttgatgcgtggttgggcgcacggatatatagaatacgcattggattttgctgctgccggattgtatgaggaagctttatctttactggaatgccatgtaaccggaactacagaaatatatcctgtcgtttattatgcaatgggatatttccatacctgtaagggagatgagagtaaagcattggaatattatcagcgggcagaaaaagagaatcattcatattgtttcccgaatcgtatagaagaagtattgattcttcaagatgccttacgtctgaatattcatggggcaaaagcggcatatagtttaggtaatttctggtatgctaaccgtcagtatgacaatgccattgcctgttgggaacattctgcggccataaatccggcatatcccaccgtatggcgtaatttgtcgttggcttattataataaacgcgatgacaagcagaaagccttggaaactttggaaaaagcttatgcattggatgagcacgattctcgtatcttaatggagttggatcaactttataaacgtttagggcggccgcatagtgaacgtttggcttttttggaagcacatctgcccgaagtagagcagcgtgatgatctttccattgaacgtatcactttgtataatcaatcaggccgctatgctgaagcaaaagaattgattgccgcgcgtaatttccatccatgggaaggaggagaaggaaaaatcaccggacaatatgtattgtgtcgtgtagaattagcaaagattgctttaagtgaaaaacgctatgccgatgctttagttcttttggatgaaacggatgcttatccatttaatttgggtgagggaaaattggcaaatgctgaagagaatgatatctggtattataaaggtgaggcgtttcgtggcttgggaaatgagcaacaagctatagattgctttaccaaagcgaccattggttcttcagaaccacaacaggctttcttctacaatgaccaacaacccgataagattttctatcaaggtctggcatggcgtgcgttgggtagagaggataaggcacgcagctgctttaacaaattgataaagcatggtgagaagcatttgtttgaccactgtcggattgattattttgctgtttctctgcctgatctggctatttgggaagatgacttggataaacgtaactgcattcattgtaattatgtgatggggttggggtatttaggattgcgtgaaatgggaaaagccattgattttttggataaggtgcgagaattggacattaaccatcaaggtggacaaatccatcgtaatttgtgtgctgtatgagaaaaaagaattttttccttttgttggtaacattgtgtctgtgcatttttgcacaggcacaaatgctgtctgtttatgaattatcatccccaaacgggcaattggtacttactgtagagaatggaagggtcttacaatattctttaagtttggaaggtaggtctgtcattcatccctctgctatttgtatgacgatgcaaaatggtaatatatggggaaagaatggtgaagtggtagggacttctacaagtagtacttctgagaaggtttatccggtagctggtaattatcgtgaattaacagaccattataatgaactttccttgaaattcaaggatggttattcagttatattccggatgtataatgaaggaatggcatatcgtttttgtggaaatcttccggagcaggattctttgattgtagttgatgaagaagcttcttttaatctggctgatgatccggcagttattttacctgaaacaactaattttacagcttgggagttgagcaatgtgctttacgagggcatttctaaaatagaagaacataaatatggtattacaccaactttatttacaaacaaggtgcaaaatgtgcgtgttgtggtggctgaatcggatttaaataactatccgggtatgtatcttcgtaaagaagatggcaagatgaaaggttattgggcgacctatcctaaaacaatagagatgggcagttggggaaattttattacggtggtaaaagaaagggagaattatttagcacgtactgctggtaaccatgcttttccttggcgtatggctattgttgccaaggatgataaggaactactgactaatgaaatgatttacttactggccaagccccaacaaataaaggatacggattggattcgtcctggtaaagcaacttgggaatggtggcattgtgctattttggaaaaagctcctttcccttctggtcatcaaaacctttcgacacagatgtacaagtattatattgatttcgcttccgaaaacaaaataccttatctactggtcgatgccggttggagcaatgtttttaatcatgcagatttgaataagaatattgatataaaagaggtgatacgctatggaaaagaaaaaaaagtaggtgtatggctttggactgttgctgctactttattccagcatccgcattgttatttggattctatcagcaagtggggtgctgttggggtgaaaatagatttttttgatcgtgatgatgctcaaataatccctcaatatgaaaatctggcaaaggcttgtgctgagcggcatcttatggtggattttcatggatgcagcaagcctaccggacttcatcgggcatatcctaatatcctttcttatgaagccatgcgatgtgcggagtgttttaagtgggataccacttctaatccggattatcagcttcaatgtatctttgcccgtatgttgggaggtggaattgattatactccggggtcgatgcgtaacagcacattggaaaaatttaagccgatcgatccggggttgcctagttcattggggactcgttcacatgaattggccttgtttgttgtactttccgcaccatttgcctgtttatgtgattctccggatgagtatcgtaagtatcctgatattttaaaatatttagcggaagttccgacttcatgggatcagacgattcccttagctgcttgtgtgggcgaatatgctgtgttggctaagcagaaaggaaatacttggtatataggcggattgaacgcttggggtgagaggacaattcaggtggattgctctttcctgcctcaggataagaaatataccattgaaatttttcaggataaaaaaagaagtaacaagaatgctaatttatgcgaacataaaataatggatacggataataagaatattattgaaatgtttatggcttctggtgggggatttgtaatggtcattcgtgaaaagtaatagagggcaatcctctatttcttttatattggcattatttatcctttttttcttttatctttggctcaaattttgaacaggctatgaaaaagactttgctcattttatgttgtttgtatgttgtatttacattacaggctgttgataagggattatccaatttttatttttctcatataacgggtgaaaatggactatcacaaagtaatgtgaaggctatcattcaggatagttacgggtttatgtggtttggtacaaaaaatggtttgaaccgttttgatggaacttctattgtacagatgaactgtgatgactatgtagtcggtaccggaaaccataatatttctgctttgtttgaagataaggaacgtcagttatgggtaggaacggatagaggagtctatcgttataatcctgccttggatatattcacggcaatgaatatggaaacagaggaaggggtgaatatgaataattgggtatctaatattgtggcggattctattggtaatatttggattgtgattcctgatcagggagtttttcgctataaggatgagaaactttatttttatgaagtaaccaacaaagagcattttaaaacagaagctccggattgtattttggtacgccctgatggtgatgtctgggttggtacatggggggtcggactttttcgatatgatagaaatacggataaatttgaacaatattgtgttgataaaaccgggcgttcgttaaagggaaagaatattaattctatttgtaattatggtgattggattgcaatggctattcatgaaggggaattgatgaaatataatcccagtacgaatcagcttgtaaaaatagatatacctgaggctaaccatacatttgtacgtaatgtggcttgttttgacgatgaactgtgggtgggaactcatgaaggcttatttgttgtgaatgagaggaagaataaaagagttcatttgaaacaagatttgatgcgttcgttcagtctgtcggataagattatttatactatttatcaagatcgggaagggggaatttggctgggaaccatgtttggcggagtgaattatctgcctcatcatgacttgttatttgataaatatgtacctggaagtgatgggcgttcgttgaccacaaaacggataagggaaatagcttctgataataagggcaatatatgggttggaactgaagacgatggaattaatatattggatattgcttctggacaggtaaaccgattgaggttagatgatgatgataaaaggagtcatatggttactttggggatgtttgttaaaggaaaccaactgttttgtggtttgttcaaacaaggattggatgtgattcagttgccagagaataaagtttatcattatactcctgaggagttgaatataggagaaggaagtgtttatactttctttatagatgaggcaggatataagtggattggcactggttggggactttataaagcggctcctgcaagttttcattttgaaaaggtggaagaagtgggttttgattggattttcgatgcatttcaagataaggatggaatgatatggttcgcttccatgggaagcgggttatggaagcatgatccgggaaagaatagctttaaaaagtatacttatgaggaaggtaaggagaatacattgggatccaattctgtcagttcggtaatgcaggatagtaaagggcggatttggatttccactgatcgtggtggaatttgtcgttacaattctcaaacggatgattttacctctttttccattaaagacggtttgccggatgatgtggcttataagatattggaagatgagcaatcaaatttatggttcgggacaaatcgggggctggtcaggtttaatccggaatcgaaggacgtgcgggtatatactactaaggatggtttgttagggaatcagtttaattataagtcagctttgaagggggaggatggtaagttttattttggcggtatagacggattgattgcatttgatcctaattcttcggaaaaaatcaatttcttgccacctgtttatatctcaaaattcagtatttataatcaggagataacagttcatactcctaattctcctttgaaaaagtgtatagaacatacggatgaaatcgtattgccttatgatcagtcaaatattagttttgatgttgctttattaagttattctactacggaatccaatcaatactattataagttggttccgttggataaagattggataagagcggcaagtaatcagaatatctcttatgcaaaattgcctccgggaaattatactttacaggttcgggctaccaatagtgtcaaagaaggtccctatgctacccggtctttatctattgttattctgcctccttggtggcagtcggtttgggcttatttcctgtatattatctggggaatctgtgttgtactttgttggttcttctggtataaaagacgtaaagagaaacagatggaagaaaagcagaagttatttgaagttgagaaagagaaagaactctatgaatcaaaagtcagtttctttactgagatagctcatgaggtgcgcacgcccttgacattgattaatggtccattggaagccattgaggaaatggatatcaaggatcagaaattgaacaaaaatttgaaagtaatcgggcagaataccaagagattattagacctgaccggccagctgcttgattttcaaaaaataggagcgagtaaatttgaattgaaatttgaaacggttgatgtaacggcattgctgaatgaaacgattactcgttttgagcctactattctgcaaaagcagaaagagttattgcaacatattccccaagaaagaattatggctgccatagataaggaggctatcacaaaagtattgagtaatttgttgaataatgctttgaaatatgcccgtcataccattatgatagatttattccaagatggagcagattttacagttcgtgttgtcagtgatggagaaaagatacctgaagcgtccagccagcagatttttgaacccttttatcaggtagaaaagaagaaggatacagttcggatgggagtaggcatagggttacctttagctcgttcgctagccactttgcataaaggcaggctttatttggatatagaacaaccggagaatacatttgttttgaccattcctttgaataaggaggaagtaaggcagcaaatagagaaggtcgttgagcaaaatatagaagtattggatgaggaaacatcaacagaaacagaccagatgaaaggttatactttattgttagtagaggacaatgaaagcatgagatcttttatctttgaacgattggaagccttgtttacagtagaaaccgctgtgaatgggcaggaagcgttggatattttacgtagtaatcacatagatttggttatcagtgatataatgatgccggtgatgaatggctatgaattatgtaaggaaataaaggcggatattgatttgtgccatattccggttattttccttaccgccaagaacgatttggagagtaagattaacggattgaagataggagcagaagcttatgtggaaaagcctttttctttcaactatttgaagactcagattttatctttactcagtaatcgaaggaaagagcgtgaggcattctccaaacgtccttttttccctgtgcataatatgcagatgaacaaggcggatgaggagtttatgaataaagtgatcaatgtgattcaagagaatatctcggatgaaaatttcaatgtggaacgtatggctgatatcttatgtatgagccgttccagcttgttgaggaaaataaagattctatttaatctttcacccatagatttcatccggttgatccgtttgaaaaaagcagccgaactgattcaggaaggtaagtatcgtattggggatatctgttatatggtaggaataaactcttcatcttacttcagcaaattatttttaaaacaatttggaatgactccgaaagagtttgagaaacagtatcaaacatccaaggaaaaagttaaaatagatctgacgggaatctctgattgaaagaaatgcagcaaaaaatgatgcatttgcggattctgcgggtgcagatgcgtcattgctgcaaaaatcctatttattgcagcgtttgtatattaacaggttgtcaagatatgcctacttttgaccatgcttgaaaggaaaagaattccggacagtaaagcaaaccttaagtagatttatctctttgacaaactaataatattatgaagaataattggttaactttaaaatcattgtttctctgtgtttctgcattgggcgtttccggtcttattttatccgggtgtactgaaaatgcaaatctaaatgtaggtgaatggtctttggagtatgatgctcacgctaatggtattgatatcagcaaaggctctaagcttatttatgataatgtatatgcagcttataagttggcagacagtgttgtttcgactcgtgattatgcaaagcatcatgtttctacaaaaaaaatcaatgattattttggagaagggtatcattatgaggtgacttataccgggaataatctgcctgcactggttcaatctttttatgtatatccggcaaaggattatgtgctgacagatttcactttggagagtacgactgaaatagcttcgaattatatggcaccggtcaatgtggaccgaatgcctgaagtattgaaccagggagaaaataatcgtgcgcttttcattcctttcgataatgactgttggatcagatatcaatctcatccgctcacatttacagaactgactagttatgaagtcactgccatatttaataatgatgaccgtgaagctgtggtggtaggttctgtagaacatgattcttggaaaacaggtataacaataggtaaaggtaatatatataatgtaggttcgttggtatgttatggcggtattgccgataagacaacacgtgactcgaaacctcacggtgcattgaaaggtacaaaaatcaagtcacctaaaattttagtaggattttttgaagactggcgtggaggtatggaagaatacgctcaggctaatgctgtgattgctccgcccaaagcttggggtaaagctgttccttttggctggaacagctggggagcattgcaatttaatctgacctatccgaaagcattggaagtttctgatttttacaaagagaatttgcagtcccgtcattttgtgaattcggataatttggtttatacaggtttggattctggttggaacagtttttcagaagaggagttgaaagcttttgtggataaatgtaaggcaaacggtcaggtagccggcgtttattggactccgtttactgattgggctaaaaatcctgaacgtgaaataaaagaaatgccgggatataaatataaagatgtatatctctatgcaaatgggaaaccgcaggaattagacggagcttatgctgttgatcctactcatccggctattgaagctatgatgaaacacacatcggagctattccatcgggctggctttgaatatgtgaaaatggactttatgacacatggagcaatggaagccgacaaatggtataatccggaaatacaaacaggtattcagggatacaactatggaatgcaattgcttgacaaatattttggtgatatgtatatcaatctttctatttctcctgtttttcctgctcattatgctcagtccagaagaattgcgtgtgatgcatggaacaagatgaaggataccgaatataccttaaatgcactttcatacggttggtggcaggataaggtttatcagtttaatgatcctgaccatattgtattgcgtgatgctacagatggtgagaacagagcgcgtgtcacttcgggggttatcactggaattttcattgctggagatgatttcagcaaaggcggttctaaagaggtgaaagagaaagcgatgaaatatttgacgaatgctgagatcaatgccatagccaatggggaatcttttcatcctgtagatggaaatggtgaaaagtcagaaaatcagtttgtacgcatggataaggatggtaaggcttattatgctgtgttcaactatatggatcaagagttgaagatgactacagctttagagcgtctagggttggattcgtcaaaggaatataggttgaaagaattatggagtggcattgaaagtactgctaaaactaacctggacgtaacggttcctgcatatgatgtcgcaattttcaaagtggaagaataaaccaatataaactttaaatcgtacttaaatttacaaattatgaaaagaattaggcttattaatttaatccttatcatgttttgttgctgtaatatgttggcacagaacataacggttacaggacaggtggtggatgttacatccgaacctatcattggtgcaagtgtagtggtaaaaggtacaaccaatggaactattaccgattttgatggcaactttacattatcagttcagaaaggggaaacattacatatttcttatataggatatgttgcccaagatgtaaaagtaatgggtaatcagcctgttaaagtggtgatggcggaagatactgaaacattagacgaagtggttgttgtaggtacttcgatgaagaagagtgatttgacaggagctgttgccagtgtcagttctaaagttttggaagaaaaaccggtgacgaatgtaaatcaggctcttcaaggccgtgttgcaggtgtgttcatttctcagcctacacgtcctacggatgatgcatctattaaaattcgtggtattaataccataaatggatctacggaccctatttatgtcatagatggtatggttatggataattcattctctggatttaatgcggtcaatttgaatgatgtggcttctattgaggtcttgaaagatgcatcagctacagctctgtatggttcacgtggttccaatggtgttgttgttattacaacaaagaagggtaaaaaaggcgaaggtaaagtttcttatgatggctggattggctttcagacctacgctaatactccaaaaacaatgaatacccgtcaattatttgaacttagaaaggaagcttatacgaatggttatatgcaaacaaatcctgacggggatgtcaatgcttatgtcaatgatgtgataatgggatcgaatactgcttttgctgattatgaattcgatgcttacgacaataataaaaattatgattggctggatgctgtgagccgtactggagtacaacacaatcatgtagtaagtctttcgaatggcaatgataaaggttcttattatattagttttggttatacagataataaaggtgtaattgaaaagtctgaacaagaaaaatacacaggacgtattaatgcggatcaacagattaaatcctggctgaaagtaggtactaatacaacttttacacgtaccgagaacacgttggttgatgatggagtaatgaatcgtgcacgttgtgctaatccgatgttggaaatttctgatgagattgaaactttaaattggcaaggtatttttgatcaaaataattttaatccgttacgatctttgaaagttgataatgatttggtgtataatcgtttgttgagttctaattatattaatatcaatcctattgaaggattgaacttgcgttctactttctctattgattatgctcagaagcagcagaataaatataccccgaatgatatttatgagtcggaacgttatggaacacaaggggaagccaaagatgatagagatacacgtactgtatggcaatgggataattcattgtcttatgaagtctcttttggcaaacataagttgaatgcgatggttggtaccagtgctacacggactacgtataattatattaatgctacggcaacagggtttggcactaatttatttggatatcatagtttgggatctggttataaaaaagatcagcgtggcttaagtacagcttggtccgagcaaacattattatcttatatcgctcgtgttaactataactatgcgggtaaatatttattaacggcgactgcgcgttacgacggttcttctaaatttgctaaaggaaatcagtggggtattttcccgtctgtgtctgcagcttggaatattacagaagaaaagttcatgaaaaatcagacaatttttgatcagttaaagttacgtgccggttttggtattgttggtaatcagaatattgatgattttgcctatttatctttatataatgtcagctatacgggtacttccgatacaggttatacaaattcttttgtttccaatgggcgacgtggtactccggatattagttgggagaaacaaaaacaatggaatttaggagtagatatggctttcttacagaatagagtacgtttgtctgttgatgctttcttgataaaaaataaggatttgttaatgagtcattcgttacctacgactactggtttcagtagtactattgaaaatataggtgcgattgaaaacaaaggtttggaatttgctttgaatgccaatttggtaagagctaaagattttgaatggaattttgcagctacattgtctatggataaaaataaggtaactcgattatatggtgataatgatgttgtatataatgtagatagtgatcgtaatattcaaaaagaaggtaatttattccttggtgagtctcgtaacacaatttatatttggaaaacaggtggaattgcccaagaaattgatatggatcgtttgaataaaataaattggaatggatataatgtgaatcccggtgatttgtatccattggattatgataataatggacagatagatcaaaatgaccgtgttgtaattggttccactgatcctaagttttatggcggtttttctacagatttttcttggaagggattgtctttaaatgcagtcttcagttattcttatggggctaaaaaattgagcccttggtatgaaactttgattggaagtactggatctggagtcgcatcaacggatttgttggatcgttggactcctgaaaatacagatgctgaatttccacgtgtgttggctggctttgattataatcattatggtgcaagttctatggattttagtgtgcagaaagcttctttcttgcgtttgtctgctttgacattggcctatactttcccgactaaagtgataaatgctctgaaactgactaacctgcgtgtttatgccaccggttctaatcttttttgtttaactaattataatggttatgatccggaaaccggtgattggtatcctcctacacgtatgtatacttttggtcttaatttggctttttaatggaaggatagaataaatagtctaattttaaaagaaaacacaacaatgaaaaagatatatagatatagtgcgatatatgctttggctttgtcctttgcactgaatacttcttcttgctcagactttctgcaagtagaacctacgggatctttgactgaggaacaagtatttgaaaaaatagataatgtagaacctttagttcttggattgtataagagttataggggctgtaaagaagggcgtaatggattgatgccttatttggggacagatgaaacacagcagggtaattatcagttgatttcttcaggagatcaagctggtatggataaatataatggacagttgaatcctacatctactcaggttagttctatttggaacaaccgttggccggctgtcgtttcagctgctaaagctatatatgcattgggtatgaccactgaagaaccggaacgtgctaaacagttgatgggagaggcatgctttattcgtggtttattaatgtttgaattaagtatgtattggggtgaaatccctgtgatagatatgaaccgtactgatgaattgggcttgggacgtcaacctttaaaaactgtatgggaatatattattaatgattttattactgctaccaataatttgcctgagtcttataatagtgaaccgcagcgtgctactgttggggctgcatgggctatgttaggaaaggcttatatggcagctccggaagagacaggattgcgggattttgccaaggctgatgaatgttttaagactattatcaatatgggacgatatgaattactaaatgattatgctgacttgtatcgttatgataatcctaatacaaaagagtcattgtttgagttgcaatttaataatgtatatcctgattgtaattattgggagtttgattgtggttctcgtgcatgtgactcttggtttggtcagggatgctctttctctggttacgattttctagttccgactccttttgcttataagacagtagaagaaggtggcatttgggaagatggagatttgcgtaaagaagaagcattgcgttatgattttacgtattatactaataaatattcggaggatggtacatttgaatatgtaactcctgatttgtcaaagactcaatggacgggaactacagatgaattggaaccacatataaagaaatatgaagactatcgtacagatattctttcagggcttggcattaataatatgtggaattctggtaagaacttttcaatgattcgttatgctgatgtattattattgcatgctgaatgtctgaatgaattaggacagacttcggaagctgtacagatcgtaaataatcaaattcgtactcgtgcatggggaggaaacttgccagaagataagaaatggaattcgggaatgagcaaagatgaattccgtgataaggtaatggatgaacgtttgcgtgaactttgcttcgaaggctggagacgtattgatttgcttcgtactaataaatttgtagaattgataaaagaacgtaaccgttgggcaaaagaatcaggaacaattcaagatttccataagcgctatcctattcctgatactgaaattaaaacaaatgatgcattcggccctgaagaccagaatccgggatatagcaaataaattgtttctatccatataaattagaagcatcaggaggaaacatctgcttcctacctgatgcttttaatttttctgaaatctggaataatatgaaaatagcacataaaatagaaacttatacctctgacggagaacctgtattacgatttactgtgatgaattcttcaggagtctatatggaattcacgaattggggggctcgttggattacagcttcagtacctgatgttcaaggagcattggacaatgtgctgattggttatgattccttggccggttatttggaagattcttattatatgggggcaaccatcggcagatttgcaaatcgtatagccgatgcttcttttacaatagataggaaaaccttccatttggaggctaatgatgggaataacaccaatcatggcggtttttctggctttcataacaaggtgtggcagtgggaagaattaccggatggcatccgttttagtctgtattcgccagacggagaaggaggttttccgggaaatatccgcgtgataacagactatcgtttcaatgaggacaatgaactttctgtacggcattatgcggaaactgactgtgctacttacatcaatatgacaaatcatgcatatttcaatttgtgtggtaagggaaaaaagataacggagcatcggttgcatattccggccgaccggatattggatactaccccggcatttattcctacgggaaaaagaatgaatgttaaaaatacgccatttgactttacttccctaaaaccaataggtacagacctgtatgctgaccatgagcaattactttggaataaaggatataatcattgctatatattgaaagatgaaatatctgtggagatgttagaggctgcctctttatacgaacctgttacaggacgaaatatgacagtgatgacagatttgcctgctgttcttttgtatacagcgggatattatgaacgaccggatacagccgtctgtttggaaacacagttttatccggatactccttctcattcggattttccttcctgcctagtgttaccggagaaagcttatgaacattgtaccttgtttcattttcaagtgcaaaaagaggaatagatgattgataaatatgaaaagactataatatgaaaaacgtaaaaaaaacatgggttgcattagccctaatgggatgtatgcaagtactgcatgcccaaactgtatatttacatagcgataacccacagatgagatggaaattaaagcctcaggctgaagtcggaacggatgtgaaatcactttgcgaaaacggatataatgtttctgcctgggtagatgctgttgtgcctggaacagcttttaactcgtatgtaatagcagggctggaaaaagatcctaactttggtgacaatattcatcaagtaaaccgcgacaaatacgaccgtagcttttggtatcgtactacattccgtgttcctgccgattttacaaaagaattgatatggttgaattttaatggggtaaaccgtcgtgcggaagtctatctgaatggaacgttattgggtaaactggatgggtttatgcatcgtggacattttaatgtcacttcactagtaaatcgtgataaagaaaatgtattggctgtacttgtccatatacctgatactccattggctaatcagggcagccctacctatttgtctagtggtggatgggattggatgccttatgtgccggggttgaatagtggtataactgataaggtatttcttacgaatacgggaacagctactttaattgatccttggatacgtacaaatttacctacccgtgccagagctgatttgagtgtggcgcttgatgtcaagaataactcggtcgaaaagacgaaggtattggtgcgcggaacaattactccgggaaacattatttttcaaaaagaattagaggtgaatgcccatactactgaacaggtgaagtttgacaaacgttatttcccacaactgtgtatagaccagccgcgtctgtggtggccgaatggatatggagaccccaatctttatcattgtaagttcgaggtgatggtggatggaaaggtttcggaaacgaaagatgtttcttttggtataaagaaatattcttatgataaagaaggtaatacattccatgtttatattaatgatgttccggtatttgtcaaaggggcgaattggggaatgtctgaatatatgcttcgttgccgtggtgcggaatatgataccaaaatccgtctgcataaggaaatgaactttaatatgatacgtaattggctcggttctgttacagatgatgaattctacgaggcatgtgataaatatggcattatggtatgggacgatttttggataaactctaatccgaatttgccttatgacctcaatgtgttcaataataatatgatggagaaaatcaaacgtgttcgtaatcaccctagtatagccgtgtggtgtggcgataatgagtccaatcctcagcctcctttggaaggatggatggcggaaaatatcaggacttttgatggaggtgatcgttattttcaagcaaactctcatgctcagggcttgaccggtagtggtccgtggggagcatttgaaccccgcttttattttactaaatatcctgatggcttggaaggagatccggcgcgtggctggggattccgtacggaaattggtacagctgtagttcctacctttgaaagttttaagaagtttatgcctaaggagaactggtggcctcgtgatgaaatgtggaacaaacactattttggccaaaatgcttttaatgcagctcccgatcgttatgatgcttccataaccaaaggttttggtaagcccgaagggattgaagattattgccgtaaggctcagcttgtcaatattgagtctaataaggctatgtatgagggttggctggatcgtatgtgggaggatgcatcaggcatcatgacttggatgggacagtcggcatatccgtctatggtttggcaaacttatgattattattatgatttgacaggagctttctggggggcaaaatcagcttgtgaaccggtgcatattctttggaaccctgtgacggacggtgtgaagattgctaataccacagcacgtgatatggaaggtttgactgctgaagtaaaagtttacaatatggatgggaaatctgtggaggcttatacccaatcagccatcgtaaactctcctagcaattctacggtgcaatgttttacgataggtttcaataaagagcgtaaaaatctgtcattgaataagccgacttttgcttcaagtaccacttatggacagccttcggatgctacggatgggaaaaaagatacccgttgggcagcggcaaaagcggaaaatgaatggatttatgtggatttgggcagtgtacaacctgtaggtggagttcgtttggattgggaggcgtcttttggtaaggggtataaaattcaggtttctgatgacgccaagacttggaaagaagtgtataaaactgatgagggacgtggaggagtcgatgaaattactttccctgaagtcgatgcccgctatgtacgtatgtttggtattgaactaggttggtggtttggttactcattatggagctttgatgtattgggtggaacacagcctagtgagggtttgagtgatgtacattttatccgtctgacgttgaaagataaatcaggaaagatcgtatcagaaaacaattactggcgtggcaacgaccgtctggactttacggctttgaatactttgccaaaagctgaactgaaaacttcttccaagttaattcgtaagaatggtgaggcggagatacaagcggtcataacacttccgaaatcggctaagggagtagcttttgctgtacatgtgcaggctgtttgtacttcggatggcgaacgcattctgccggcattgatgaatgacaactattttacgttgatgccaggagaaacaaagaatttgagcattacatttgatgagaatttgttgcagggcgacaaatataagttagtggtaactccttataataacaaataattcagattagtatgtgtactaataaatttattctgttctgtatggggatagtgatgagtgtatcatcttcagcttgggctggagatgacacccctctttataaagacagaacagctccaatagagaagcgtgtagacgaccttatgtctagaatgacattgcacgaaaaggtattgcaattgcagaatcgtgcgtctggtcggttggatgagattgaccggatcttcttgggggaaagttatgggacaactcatgaaatgagtatgtctgcttatgattgcgccgtgatgtataaagaattacagcattatatgcgtactaagacccgtttgggaattccgttgttaacttctgctgagggcatacagggtattattcagaataattgtacgctgtttcctcatgctttggcgcagggaagcactttcaatcctgaattaatacaacaaatgactgaggcggctggcgaagaggctaaggcgataggtattcatcaaattctttctccggtttttgacattgcccgcgagttacgttggggacgtattgaagaaacatacggagaggacccttatctgatagcggaaatgggagtggcgtttattaaagggtatcaaaaatacagaattacttgtatgcccaagcattttgtagcccatggtactccgtctggaggcttgaattgtgcgggagtaagtggaggagaacgtgaattgcgtagtctctatctttatccgttccgtaaagctataagggaaacttctccgtgggcggtgatgacttgctacagtgcgtatgatggagtgccggttacaggttcttcttattatatgactgatattcttcggggagaactgggctttaaaggatacgcttattctgactggggttcggtggagcgtctgatgacttttcatcatgcagcaggcagccgtgaggatgctgcgcgtatggcattaatggccggagtggacttgaacattgattcgacttacgaaacattggaaaaacaagttgaggagggaaggcttgatgttgcatatatagatcaggctgtgcgcagaatattgacggtgaagtttgaattgggcttatttgatgaaacttatggtgatcctaaactggtgaagaaggtcgttcgcaatgctgaaaaggtggtattggctaagaaagtggctgacgagagtgccgtattattggaaaacagaaatgatattcttcctttagacttgaataaatacaagtctgttgcagtggtggggcctaacagtaatcaagccgtgttgggcgattacgcttggacgatgggggatactaaagaagcagtcagtttgttgcaaggattgcaggaaagtgcaggtgataaaataatgatccgtcatgctgaaggatgtgattggtggagccaggacaaatcacatattgccgaagctgtggaagttgtccgtaacagtgatatagctgtggtggcggtaggtacacgaagcacttatctgggaagaagtcctaaatattctacggcaggtgaaggatttgatctttcctcattggaacttcctggggtgcaggaggagctgttgaaggagataaagaaaacgggtaaacctatgattgtcgttctgattgcgggtaaaccgcttgctatgccttgggtgaaagaaaatgctgatgcagtgttggtgcaatggtatgcaggtgagcagcaaggacgtacattggcagatattttacttggaaaggtgaatccgtcgggtaagttgaatgtatctttcccgcgtagcacaggtaatactccttgtttttataatcatttcgtgacagatcgtgaagaaccttttgaccagccgggtactcctgaagaacctaaaggtcattatatctttgataaaccggaacctttatggaactttggacatggaaaaagttatactacgtttgattatgtggattgtgcactgagtgatacgttattggctgcaagtgatacattgaaagtatccgttatgatcaagaatacgggtaggtgcgatggcaaggaggttgtgcagctttatgtacgtgataaagtaagcacggtggctactcccatccaacagttaaaggcatttcaaaaagttctggtcaagtcgggcgaaagtcaatgtgtggagctttctttgccaatcgcagaattagctctgtataatgcaaaaatggaggaagtggtagaacctggggactttgaaattcagataggagccgcctcagatgatatacgctttaagaaaacaattactataaacagaaaataaacgtgcttgttttttgttatttcttttctgataacaagaaggcaaaccatgtgatcgtattgttagtactggtatgtatatattttcttgttaatttacaactattttatatgagaagcatcttgttttttctttcttttttcagcctgacgtgtatttcttacgccaaggtggtcttgcccgcttattttacggacaatatggttcttcagcaaaatacgaaggttacttttcatggtaaggcggcattgggcaaaaccttaaaagtaactacaggctggaataatgaagtgtatgtgactccggtgaataaggatggttattggactttgtctgtgcctactcctgctgcaggagggccttatacgttgacatttacggatggtaagaaattgcaattaaaaaatgtaatggtgggagaggtatggttttgttccggccagtctaatatggagatgcctgttgcgggttgggggaaagtcatgaattatgagcaggagatagcggaggcgaattatccttctatccgtttgttccaagtgaagaaaaatacttcagtaactccgttgagtgatgtggaggctacgatgggaggatggcaggaatgttcttccgccacaattcctgaattctcttcgctcgcttatttttatgcccgttcattatggaaggagttaaatgttcctgtaggagtgattgactgtacatggggaggaacacctgctgaagcgtggaccagctatgaaacattgaaacaggtactgggctttcatgaggagttggctaagatggaacaattggattttgaccctgttcgtatggaaaaggcctataatcaagagcgctccgagtggcaatctcttttttctaaggaagacaagggaatggaggaagataagccttgctggattgcaccggacttgtcagaagaacaatggcaggatatgtgtcttcccggttactgggaaaggaatggattgaaaaattttgatggagtagtatggttccgtcgtagtcttgaaattccggcagaatggattggcaaaccgttaaaactaaatttagggatgattgatgatgaagatattacttattttaatggggtggagattgcccgaggggcaggctatatgacaccgcgtacttataccattcctgcaaaattagtgaaggctggtaaggcggttcttgctgttcgtgtttctgattttggtggagagggcggtattcatggcaaggcggaggaactttatgtagaagctgatggaaagcggatcagtttggcaggagattggaaatatcgtatcggactttctttaaaagggtttccacccgcaccggtttctcccattcaaagttccagttaccctacggtgctgttcaatgcgatggtcaaaccatggactgcttttcccattaaaggagtaatatggtatcaaggtgaagctaatgtaggtcgttcggaacaatatgaagatttgtttcctgctctcattacggattggcgccggcaatggcgaagtgatttccccttttattttgtacaattggctaattttatggaatccaaggaaatacagccggattccgaatgggcggctttgcgtgaagcacaaactaaagcattaaaacttgaccaagttggtatggctgtgaccattgatattggtttggctgatgacattcatcctaagaataagcaagaggtgggacgccgtttggccttggttgccctggtcggtagttatggaaaaaatgtttccggttcggctcctgtattccggaattatagaatcaaaggggataaaatggaattggatttcggacaaaagcaagatggatttcagattaaaggtacaactttaaaaggctttaccattgcagggccggaccgtgtgttttatccggcagaggcgatggtccagaatgggaaaattatagttttttctcctgaagtttctatccctcttgctgcacgttatggctgggcggataatccggattgtaatttgtacggagagaacggcctcccggttgctcctttccggaccgactgttggtagagggcgtaagtcttaaccttttttcttctctttgtaagctgatggaggcactcccatcgtcttagtgaataaccgggagaaataaagagaatcctcatagcctaccaagggacttatttggttaattttcaggttggtaaaatccaggtaatgacaggcttcctgtattctgagataggtaagatatcgaagaggagaggagcctgtcttttcttcaaacagattagagaaataggaaaccgagaggtttacttccgcagcgatatctgccagacgaatggtcttgctcaaattttcttgcatgaaatgaatcgctatttgcactacatctttgtttctgtaactattgcgcatagagccacaatcccgatattcgccaataaatttcatggaacctaaaaaatggaagagactagtagtggcataaagcatataatttttgctatatccgaaactgatggacgagtagatttcttcgaagagtactaatctttctttgattcgtgaatcctcttgtggagtgatgcttttcggacggtcaaaaccggcactgaaaaatgcagcttttgttccattgaaatggatccagtaaatagtccagggattttcctcattactgccataagcgtgtgcttggtgttcgggtagaatgaaaaattggttggcggtaactgcatattgatgtttgtctaactcgaaccacccttctccttccatacaataaatgaggataaactcggttacttcctcggtgtcgcgtttccggtaatgaaaataggcatgaggataatatcctatatctgtgatgtaaagttcactgcctaacggatcttgctttaattcttcaatcagaaaagcaggaagtacgatagcgcgttctcctttaaatccatctttaattcgtggcatatatccatgtattagaattggataacaaagatagcatatttccttgattttacctacaatacaggcttgatttcgatgattttgagggtataagcgtcaaaattcttattttatggcgcatttgagtagggatttttgagcttctctctctatttttgcactataattttaatcgatgaataataccatgaaagaaagattgctcttcttgatatgttttttatgcatatcatttatgttaaaggcggcggataagccagtaattaaaattagtacagaaaatgtagaccttatttaccgggttggtgataatggacgtctatatcaaagttatttgggaaagaggttgaatcatgctacagatattgcccacttgccgcagggcagcgaagcatatctgactcatggcatggaagattattttgaaccggctattcatatagtgcataatgacggcaatccttctactttgttaaaatatgtatctcatactcggaatcaagtgtcgccgggggtagatgaagtagtgattactatgcaggatgataaatatcctgtaactgtaaaacttcattatgtggcttaccagaaagaaaatctaataaagactttcactgaaatcagtcatcgggaaaagaaacctgtgcagcttcataagtacgcgtcttccatgttgcacttgaatcgtgccaactatttcctgactgaattctcgggagactgggccagtgaggcgcatgtgaaggaacagcctttggaatttggtaaaaaaacgattgataccaagttgggagcacgtgccaatatgttctgctctcctttcttccaacttgcattggacggaaagtcagaagagaaccaaggtgaagtgttggtcggaacattaggatggacaggtaatttcagttttgtattcgaagtagataataagaacgaactgcgtgttatttcgggtattaatccgtatgcttcggaatatagtctgaaaccgaatgaaatcttccgtactcccgatttttattttacttacagttttacaggtaaaggacaggctagccgtaatttccatgattgggcccgtaagtatcaggtaaaggatgggaaccagactcgtatgactttgttgaataattgggaagccacctattttgattttgatgaagcgaaattggtgaagttgatggatgatgcagtagaactgggtgtggatatgtttttgttggatgatggttggtttgccaacaagtatccgcgcagtggtgatcatcaagggttaggtgactgggatgaaacggctgacaagcttcctcatggcattggttatctgacggaagccgccaagaaaaaaggtataaagttcggtatctggattgaaccggaaatggtgaatcctaagagtgagttgtatgaaaagcataaagactgggtgattcatcttccgaaccgtgacgagtattatttccgtaaccagttggttctggatttgagtaatccgaaagtacaggattatgtgttcggagttgtggacaatttgatgacaaaatatcctgatatcgctttcttcaaatgggattgcaatagccctattacaaatatttactctgtttatttgaaagacaagcagtcacatttatatattgattatgtgcgtggcttatataatgtattggaacgtgtgaaagcaaaatatcctgatctgccgatgatgctttgttccggtggcggtgggcgttcggattatgaggctttgagctattttacagaattctggcctagtgataataccgatcctattgaacgtttatttattcagtggggattttcacaggtgttcccagccaagacaatgtgtgctcatgttaccacatggaataagaatagcagtgtgaaattccgtacggatgtggctatgatgtgcaaactcggttttgatataaaattagcggatatgagtaaggatgatgaaacttattgccgtactgctgtacagaattataaccgtttgaaaccggtcgttctggaaggcgatatgtaccgtttgatatctccttatggcagtaatcatacctctactatgtatgtgggcaaagataaggataaagcagttgtatttgctttcgatattcatccccgttatgcggaaaaaacattgccggtgcgtttgcaggggcttgatgcagacaaaatgtatcgtgtgaaagaaatcaacttgatgcccggagccaattcttctttatcaggcaatggtgaggttttctctggagaattcttgatgaatgtaggattgaatctatttactacacagcaactcaacagtcgtgtagttgaagtagtagctgaatgattagggattgattgtatataatttagtgtattgccttcattatttgtttttatgaatgatgaaggcaattttcttttctatagatgaatgatacttgatcggtttgattatgaatcatagaagatgccgtgacacatgatagatcttcaggtgtcatcgttatatatgttacacttgtaagatatataatctttcgggtttaggttctatatcagagcggactgttacttgttaagaaaaaacattcatagcctccggaggttggaacaggggactaacaagtttgttcaagcagggctgttgcagggggcgggttttatatcttgggggaagtatatatttatatataggctccttcacatccaattttccttccgtaccagaatattttttactctgaagacagatctgaccttctgaattacattaacctgcgcacatctacaataatcaactttttcttgaacagtctgttgtatcttcgtgtccataaataaaatgaaaaaggaaaatactgaagttttaactctggatcatgatagtccgctttttaccgttattggacgatgattaacgaatgtagccgtaccgataaggaattcctcgtaaataggacggaaaccaaagcatatgagatgggtttgtttctttcgacgaaatcaaaggccggtcatgattgcgttccatcatggtaatgatattctttgtatatactttgtttatagatgttgaattgatctctttatgtatgatatttgtcttcttgtgtaagatattttaaaaatcaaaaacaaaacgaaccgttttttttgagaaatctaacaagagatacccacatttgtactatctttgtaataagttggccttttaagaaaacttgggaaaagcatttattatgaatcaatatccggattttgaccaaaagttatatgacgatcttcgccgtggtaaagagtatgcctttgctgctgtctttgaccgttaccatcggttattgtacaccatagcctatcgttttttgaaatcggaagaagaggcggaggacgcagttcagtatctttttatgaaattgtgggagcagagggaaacttttagttttgagtcgggtattcgcagtttgttatttactatcttgaagaattatatactgaatgaattgaggcatcgcaatctggtatttgagaaattgtatgaaatggcccaacaggtgaatgatgaggacgaagatgcttttttaacccggtttgaacatggtgaactcagaaaatccttgcgggttgccattgacaaacttcctcctcagaaacaaaaaatctgcttgctgaaaatagaatatgggttatccaatcaagagattgccgacaggatgggcataactgttcctacagtgaaatctcattacacacaggctataaaggcgcttcgtaatgcgattgaatctttgattatgtggtttcctgtaatatggatttatttaatagactgaaatgcactcatacttttatcggagtagggtgttattataaatatatgaaaaaaatagattatgaagatagatgaatcggtgatagataaagtacttgacaacaaagctgctcctggagaagctcggaaagttgccggttggttcgttacggaagaagggcgtaagtatttgtctggacgattggaccgtgagatggaagagcttgcagaagaggtgccggaagatgttagacttccttttattcccggcatgaagatgaaacagcggtttatgagtgagataaaacgtgagcgtggaaggagatcggtcggccgtaagtggatgtgggtggcggctgtattgttaccatttgttttcttaagcgtttctttgttgtttttggtgaaccggacggggattttctctgaaacggaatatgctgaaataagtgttccttatggtgaacagatgcgggtaattttgcaggatggcagtattgtacacttgaactcggattcccgtttgaggtatcccaagcaatttggattgttcaatcgtacggtggagctttggggagaagggtattttaatgttgccagagatgaaaaccgtccctttaaggtggatttgcaaggggtggaagtgagagtgaccggaaccagatttaatgtaaaagcatatgctgccgaacccaatatttgggtaactttggatgaaggaggaattcttttcagggatcataatgcgaaggagtacaggcttgttccgggggagagtgcggaatataatcgtcagtcggggaaatgcctgatttcccgcccggataatatggagcagatttcggcatggcgttccaacagccttaatttttatctgactccgcttaatgagattataaaggtgatggaaaggcattatgacgttcattttattgtgaaagattctacggtactgaagaacaggtttactttgtcaacaggaaaagtaaacgcgtcggatgtactctatgatttggaaactgtttctaatatctgttttacggaggtggaagacggtctgtttgaagtaggcaccaaataatggaaactataaaggtaaatgtggaatagatgtgagtgaatacacttgcatctatttttttttgagaaaacgaaaaaaaggactcatacctttttctggatgatgtgttagcctatataagaaattcttttgtttcaaactaatactattgatgaaaatgaaagcaagaaccaaaatgaagacattactgctgttgggagtccttttatttggctttactgtttcagcacagtcgcaaaaagtctctttagattttaagaatgagagggtggaaaaagttctggcatctattaaaagccagaccggtatgagcttggttttcagtgaccagttggtcgatgtgaatcgtaaggtaaccatgcaactcaaagatgtcacactgaaggaggcattgacaagacttctttcaggaattaatcttacttttgaaatcaggaacaacaaaatctattttattgagaagaaagctgtctcgcaacccggttctagaaagaaaagagtgacgggagtggtgaaagatgtaatgggagaacctctgattggtgctaatgttgtggaaaaaggcagaagtaccaatggggttatcaccgactttaatgggaagtttacgttggaagtggacgaatctgcttcgttggttgtgagctatataggatatttggcacaagatattccgacaaaagggaaaggggattttcatattatattgaaagaggataccaatacgttggacgaagtggtcgttaccggatatggagatttcaagaaggcaacttatactggatctgcttctgttctgactacagaaaagctggaggctttacctgttgtctccgtggggcagatgattgaatcgaatataccgggcatcagtgtggttgccggtacttcttcgcagcccggtgcgaaaacaactttacgggtacggggagttgcttccatgaatgcttctaccgaacctttgtatgtattggacggagtacctatcccatcttatgacttgagtaactttaccagtatgtccgaagcgggaggaatgggattcattgaaacgctgaatccggcggatattgagagtatcaccgttttgaaagatgcggcatctgcttcattgtatggtgcgaaaggtgctaatggagtcgtgcttatcactactaaaaaaggaaaggaaggcaagcttcgtgtcaatatggcggcgaaatacggaatcacagatttcgcttatacatatcgtccgttaatgggaggcgaggaaagaaggaaattaattcatgaaggattggttaattttcaactggataagggagtaagcgaacaagaggcacagcagtatgcggatgcgaatatagaccagtatgccaaacgcttgcctcaaggatattcggactgggagagtgctttatttaagacaggttatcaacaggattataacctgtctgccagtgctggcaaccaaaattccagttttatcggttctttgggatatactaaacagacgggtgtttccctgaattcagaaatggagcgctttacggggcgtgtggatgcaagtaacaagtataaaaaggtggaatttggaatgaacgcttctttttcgtggacaaagaacgttcatttacccgaaggtaaattttatggaagtgccatttatgcatcaaaagtgaatctgacgccttctactcccatttacaatgaggatgggacctatgccagcgggtatcgtgaaaacaatgggtataatccgatattggaggctgaggtgaatgattattacgctcggacggtacgtgctatgggtacggctaaaatagcttataatgtttgggataacttgaaggtatccagtgtgtttacggtagattattcgttgacaaaggactttttctttcagtctccggatggacgtgatggagcaacttatcaaggacggggacgtatgcagatgactgaccgtatacgttatacttcacagaacaatttaacttactccaaaactttcggcaagcattctgtcagtgcggtcacggctttcgaggtgatgaagtatgattatgaggatttgtatgctgcaaagaaaacttacgggcaggatataaacacttctttaggaaatgcggccgatccgatagatgctgaccagaaattgcaggaagatgcattaatgtcctatgtggccagtgtgaactattcttatgatgataaatattatgccagtttcagttttcgcagggatggctcatcccgcttgtctcccgatactcgttggggtaatttctggtctttgtccgcttcatggagactttctcaggaaaggttcatgcagccgttgaaatcagtattaagtgatttaaaacttcgtgcttcctatggggtgaatggaaatctcccttcttcatattatggttatcagagtacttataccacgggggcgttttatagtgggaaaccttctccgtgggaaagtacattggggaatgaggaactcacctgggagaagaattatgcactgaatttgggactggatatcggcttgttcagtcgtgtgaatgtttctttggattggtacacgcgtacaacgaaagacctgttgatgagcaagcaattgaattccatcagcggattttcttctctgctgaccaatgtggggcagatgcggaataccggtgtggaacttgaagttcgttccaataacatcaagacgaaagatttcagctggactaccgccttcaatttgagccataataaaaataagattctgaaactggcagatctgccttggtttgtggatggcaggtatgtacgtaaggaaggttatccatttaatactatttatctgcgtgagtatgcgggggtggatcctgagaccggaagtgccttgtattatgataaccaacaggatgagaatggcaattatacaaaaaataaagtgaccgatccggggcaggcaagtcctattccgttgaaagatattacgcctactatatcgggaggttttatgaatacctttaattataaattcattgacctgtcattcaatctatcttatagtttcggtggttattcgtatgataatgcatcctacattctgcaagatgatggttattcagtgataagcaataaaagtaccgagcaacgccgccgttggcagaaaccgggtgatataacggatgttccccgttttgtatatgggaataaaaaggggggtaactataattcttcacgtgccatccattctacggatcatattcgtctgaaaagtctgatattgggattgaatgctcctaaagcatggttgcagaaattaggaatagggaatgcccgtatttatttctcgggtacgaatttgttgacatgggctgcatacgaccaatatgatcctgaaatgagtggggtggtaggattctacacgcctccgttgaaaacttatgctttcgggctggaacttaaattttaatcatcaattacactaaaaaacagaaccattatgaagaaaatacttcttattttaggattcgtttcacagctcgttgccggttgtagtgatttcttcgatacagctcccagcaataaaatccctactacgatggctttccgtacagtaaccgatgtggataatgcggtgaacggattgtatgatctgatgtcgggctccggatattacggggctgctatgtttgcctatggagacatgaaaggagatgatatgcagagttctgaggaaagtggggtatgcaatacatgctatatgttcaatcatcgtcctaatagtttgaatgccggttcattgtggggacgacctttttatattcttcgtgaggcatggaatattctgaatgctattgccgaaggaaaaattgaaagcggggatgaaaagaagttgaatgctttgaaaggcgagacgatggcggtgattgcgctttgccagtttgatctgactcgttgctttggctatccttatacaaaagataaaggtgcgtcactgggtgctccgttgatagaccatttggtgggaacctatgagaatcctccccgttctactgttgctcaggcttatgattttattatagaaacgttggaagaggcggttacattgatgtccgaagagaaaaataacggacgtatgaataagtatgcggctcgtgcattgctggctcgtatctacttgtatcatgacgataaccggaaagcatttgatttggcggaccaactgattaaggatgcggatacatcgggaagttatgcactttatccgcatgagaagtatgtggctgcctggtcggtagaagccaagtttggttcagaatcgttttttgagatagccaatagtgtggatgatactccaggacgggattcatggggatatttattgaattggtatggctatcagaaggggtttgtcactcagaaatatgcggagcaaatgctggctgatcccggagatgtgcgcgggcagttgctggaggagaataaatatgcggggaaaacggtatggtggttgtacaaactgagagggacggacctgaagactgcaccgctggaatgtaacaatgtggtacttcgtctgtccgaggtgtacctgattgccgctgaggctggttgtaagttgggcggtgatgctgcggttcagggacttggttatttgaatgagattgtgaagcggggcaatcccgataacgaagtgacaatggctgactataccttggaccgtgtgttggatgagcgaagtaaggagctggtaggtgaaggacatcgtttctttgatttgctgcgcaatggcaagactattgtccgtaaaggaggatatcatcttcccagtgtggacgaagaggtggattgggatttttacaagtgtgtgctgccgatacctgaagaccagtttatctttagtcctgagatggaacagaatccgggatatcccaagaattgacatgctattaatcattatttaaatatatacgtatgaaaaacagaatagtaatatttgtggtatttgtgtgttgcttatggactatgccgggaatagtacgggcgcagttgtctgttcatcagtttgaccagttaatgaaaaagattgatgatgtcctgtggtacgagaaagtgggtgatattgcccatgtagataaggtgatattatgtggaccaccgcgttggaaggagtccaatcccacttcgatgagtgctggtaacgaacttaaattcagagcatacatttttattcccaaaagtgtgaaggaaaacaagaaatatccgttgatcgtatttcctcacagtggggtacatgccgatatggacacctattatgcccatatcatccgtgagctgatagcgcaggaatacatcgtggtggcagcggactaccggggaagcaccggatacggagcgggaacatacaataatatagattatggtggattggaaaacgaagacgtgtacatcagccgtaactatatggtggataatttcgatattgtggatggtagtcgtgtgggtatcatgggatggagtcatggtggtatgattacactgatgaaccttttcaattatccgggacaatataaatgtggttttgcaggcgttccggtttcggatgtaatcatgcgtatgggatatgccagcgacagttatcgcaaaatcttctcggccaagaatcatatcgggcagactgccaaggacaatattgcggaatacaaacggcgctctcctgtgtggcatgcggagaagttgaaagatccgttacttatctatactaataccagtgatgatgatgtgaatgtagtcgaggtggaatcaatgatccgtgccttgaaagcagaaggcaaaaaatttgaatataagatatttgagcgtgctcccggtgcgcatagttttgatcggttagatacttatgagtcaagcaagattcgtctggacatttataagttcatggggcgttacctgaagcccaataaaccattcggttcagtgaaagaattgcgtaaagcagcttataagttctgataattaacttggtgacaggataatggagggctggttgcttcatgtaatggggcaaccggcctttttatgactcttcggatggataaaaatgagtgaatattcatcttgtataaaagataagtggaaatatggataaagtgtacggataataagtgataattaaactttttgaatagcttggcggcttgttagcttttagaacgtagttatacattggtaatgagaaatagatcatgaaaaacacacgcttattatttgttatttggatgttgttcttggttttacctcaggggtattcacaagagaaaaaggaagattcatccgtattggggcaagtgaacggctttttgagtaaacatgtgaagctgactgcctacggtcagttcggttatagctatacggacaggaaagacttggatgtgagtcaggcggacaatcagttttttggaaggctggggatgctgatcctttcgggagatatcacggataaactgtcgtggatggttcagtatgaactgtttacttcacagctgctgaaactctatgcttgttacaaaccgtattctttttttcaggtcaagataggtcggatgaagacctgttttacattagagaaccagatgtcatcttcggtttatgaaacggtaaacttcagtcgtgtcattgagcgtctggcaggtttcagtggagatgtatgtgggaaccagggtggccgtgatatgggtttgcaggtgggtggtgagttgttcaagacctctgtcgacgattattttctggaatatcgggtaggtgtatacaatggttccggactcagcatgaaagatcataatgatgcaaaggattttgccgcatggttcactgtgcagcctgtcaaaggattgaagatgggtgcgtctgcctatatcggaaaattgaatgatgattatacggtggtaaatgatgaaacgggggaagaaaccatttataatacaaatatgaaacgtaaccgcatggcgctgagtacctgttatcagacccatcggttgacttgcaggggggggaatatttgtggggaaaagatggtagtatcaaccgcagagtttttttatgctttaggatattggtttgccattccctcccgattggcggttgtggcaaaattggaacgctatgaagctgatacggcagtttctgattcagaaatgatttatacagtgggaggcgcttattatataacgccgaaaacgcgtatcatgctgaattatgcgcattttagttatgaaaagagtgtttctgtcaatgaactttgggcgatgtctcaaataggtttctgatagtacaatatgcaatgtttgtattgtgtctttttataccttgtcgtgttttataggttgctcaaagtcataaagactttggatgttaggtctttttctatattttttcttcactatttctgaaagtaaatattgaatcttttgactgaaatagtgagagcgtgaagcagaacttggcacaagatttcacagaacttggtgcaggatccggcagaacttgtatcaagattccaggtactatggtagggaaaaatacagctttttgaaaccggacaaggagccttggacaacctttccccataattatcgggtaagtcttcatctctactatttgtctactgccctgtaaacgagggcttaaagcataaaaaagcagttacattttactgtaactgctttaaagtgaaaaacttactttggtggtgccaccaggaatcgaaccggggacacaaggattttcagtcctttgctctaccaactgagctatggcaccaaaatggttatcggtagagcttttcactttgtaatagaagacctctcagaaactattgtttcttgttttcggttgcaaaggtaggcatattttttgattctacaaattttttgcaaattttctatgaaattctttttgatttcaaaaaaatgctttacctttgcactcgcaaaacagaaacggaatgtagcgcagttggtagcgcactacgttcgggacgtaggggtcgggcgttcgagtcgcctcattccgacattgtaaaggataagccactgaacttcagtggcttatctcatttttagcaaatccgccgggacgaaatcgggacaccctattttatgggtcaaattctattctcggattataatgctaacatcctaccagccgaatattttttgtgaaagtatatagggaggtaagagtttttcgttatctttgctccctacatgataaaactgattttattttcctgttaaccattaggatcataagatataccttcttgatgatttctttaagtaaaaaatgagaattaatgaatatgagaaatttgtttttgactttagctttcggtctatgttccggcgtattcgcccaaaatacgactgtttttgaatctcctattatggggtggagctcatggaatacctatcgggttcatatcaatgacaccttaataataaggcaagcggatgctatggtgcaaaaaggactgaaagaagtgggctattcctatgtgaatatagatgacggtttttttggatggcgggatgaaaaaggagtgatgcaaacacatcccgagcgtttcccgaacggattgaagggagtggcggatcatattcattctttaggattgaaagccggtatttattcggatgcgggaagcaatacttgcggttccatctgggataaagatatgaacggcataggttccggtttgtatggacatgaatttcaggatgccacgttgtattttaaagagtggggatttgattttatcaagattgattattgcggagccggtcaggaattgaatctggaagaagaaaaacgatataccgaaatacgccaggctatagataatctgggttgcggacatgtttctattaatatctgtcgatgggctttcccaggtacttgggctagaaaccttgctcgttcatggcgaatcagtgcggatatccgcccggagtggggatcagtaaaatatatcatcgataaaaatctttatctgtctgcctatgcgggagaaggtcattataatgatatggatatgttggagataggtcgagggctaaaacctgaagaggaagaggtacattttggaatgtggtgtatcatgagttcacctttgttgataggatgtgatctgacaaccattccggagacgtcattaaaactgttgaaaaataaagaactgatagctttgaaccaagaccctttaggattgcaggcatacgtagttcagcatgaaaatgaagggtatgtgttggtgaaggatatagaacgaaagcgtggtaatgtacgtgcggttgctttatacaatccttcggatacgatttgtagctttacagttccgatgaatattttggaattaggaggaaaggttaaggcacgcgatctggtgaaacaccaggatttaccggagataaaagggggtgttctgaatcgagaattacctccccatagtgtgctgattttacgtatggagtccgagaagagattggaagcgactgtttatgaagcggaatgggcttatctgccttgtttcaatgatttgggaaagactccgaaaagcatcgtatatgctccgttacatgaagcatccggaggcatgaaggtaagttatctgggagggcggaaagagaattttgcagaatggaaagaggtgtacagtgagcagggcggtgaatatgaaatgactatccgctatgtgcctaaggcagaccgtaaactggaagtctgtgtgaataatgaaaaaaggattcttcttgattcgctgtcggcggatgaaactcaaaagatagcttcgattactgttccggtgcatttgaaagcagggaataataagatacgtatgggaagctcattttgctgggctccagatatagactgttttactttgaaaaaagtaagtgagtaggctgataagatctatcttcttgaagtaccactttgataaagagtaagaatatgagtgtaacaaatgtcacccgtgaggaattgtgggcaaagcaacatttgtcttgcaaaaacatggattatgcggtatgggaacgggataaatccatgctccagaagttgtccagaatcaatggcggctgttctttcgtggtggatgtatataaaggatgttatgcgtatgcttctacgggttttgtcgattggttggggtatgacaggcacaagatagaaacattggaaaaacagggtgattatctggagtcacgtattcatccgcatgatcgctcccaattggaagacttgcaagtcaggctggggaagttcatttataaccagccttttgaacatcggaatgactattgtaatgtgtatagtttccgtatactcaatgctcgtggcaactatgtgcgtataacaagcaggcatcaagttttggaacagagccatgacggaaaagcatggctcattatagggaatatgagtatggctcccggccaaaaagaatcagaacaggtggaatgtactgtgctgaatctgagaaatggagaaatgttttcacccggtgtgatgataatgaatccggctttcggtcttaccggacgtgaaatggagatattacgcctcatccaacgaggattcttaagcaaagaaattgctgataaattatgtatcagtattcatactgtccatattcaccggcaaaatctgttgcgtaagctgggagtacaaaactctttggaggcaatacgcctaggacaggagtcggggctgttaagctgatgcccgatttcatcgggtcaaggcatccattctactactcctgtaacaggatgctgctttctccattccttaaatccgctataatcccgcaccccatcccggatgactgcctgataatactccactccgatgattttctcggtttccggtgtttcatattttaatcttagaatagtttcccgtatttcatcggtcataatttccgaaatgcgttgggctaccttttcaaaataaccgtcataacgtgaaccttcccggatgtgaatcatatccatctgccaaagttcattttcttcattttgataccatgcatgccattcgatacaggcttcggcagtatgcagcagattagcgcattctattcttttgatggacggattctcagctagtctggccattgcctgaaagctgtccgtcaggtttaagggtgatgaataaatatggaaatcaatgtccctatgtttcatcagcagccctgttctgagtgaacctaccagattaatttttgcaccggcatcttcccatatctggatgatgttcgtgtttttgataacttgccaggctttttcctgattctgtttggcaatgtcgaaaatattcatacgctgtcttttatagttggtttgcaaaagtagagaaaagctttcaaactgaagatagttataaataactatttattgccggaatgaatcgggagaaagggggtaacaaggaacttagtaatgtttccttttcaagtaaatgacagattgtattcccaacatgatgacaaacagatattcggttgtcatatataccgctaaaggtgcatgtacacagtggctcagccagtaaagataaagaagatataccataatggtaaccacttggaagataaaggcaatttttgtctttccggttccggtgacggcactgatgtagacatatccgggtactgcgaatatataattgaacagcatgacgatgaaaggggggacagtgtgttgcaccagtgtttcgttgttggtgtaaaatccgataatccaataatcacaaaacaatgcgactcctaccagtggaaaaccgatggcatatcccattttgatgattttgtggcagataggaaaaacacctttttgttgtccggctcctaaaagattgcttaccaaggaaccgttggtggctcctaaagaactgacaatcacaaaaaagagggtggaaacgctgcgggttatgttggaaacggccagttccatctttcctaaatgttcgatggcgatgaagaacaggaaccacggcgccatactgataaaagaatgcagcatgctccatacggacaggtaaaacagtcttttcaatagctttccatcaaatatcggttgcagtccatacttgtttttatcaatctttctccacatatggataaggagaatgattaacgatcccatttctgctagcgttgaggctattgccgatcctgctatcccaaattttaaggtaaatattaacaggtaattgaaagggatgttgataagtacggctgctattgcggcccaagataaggacctggtctttattattcccacaaagaaagcccggagtgccagaaagggaaatgaaaataaaagtccgaaactgcgccagtccagatagtccgttacagcctgatagatttccggtgaggtaattaattgtttcaagaggaagggggaaaggccctgtatcaacaaacataaagagagtgctagtccggaaaggaaaaatagtccttgaaagaaggtacgtcctgtttctgcatagttctgttctccattcctgcgggcaatcatgacttgtagtcctatgctgaaaccgaagcctagcatataagttgccagataatatattcctgccaaggcagatgcgccaagttccacttcaccgacatggcccagaaagacggcatcggtaatgttgattaattgctccattaaaacgctcatcattacaggaaggttgatgagccatatttgtttatatgtataattcattgtttaacttaatgtataaccatgcttatgcacttatcggtttagggatggtgcacaatctgtgtggattaataataagggtataaaactctgtaacaaatcttatttaagatccgtcaaaatagccaaatagtttggattggtagtgctattcgttgaatgtagctatatacagagttgatgtttcattagttaaacaattgtgttttgcaggttaaatcaaatctcctggttcggcataaattttgtattcgctctctagtcccttgaaatcttttctgaggagtacaattttagctttgggggtaagccaaatgtttagtggaatggcattcttctcttgaaatgaaaatatagtgctgaattcttttctcaaagactcgtctgaggttgcggtataattagggagtgagaaaaatgaatttatgtagttatacagtatttgtttgcttttcatagatccccctttttcatatttctcatttttggcatacagcataacagatgggacaccttgatggatatgggtttgcgtactcagataatatccgtccagattatttgcatagcctgtggtaaaatcggagtcggttacgtctttccaattgaaagcaaggaaatcttttttatttgtgatatcaatggatattgtatcactactatagattatttcattgtttttgtaacctagcagataagtcttgtatgtgccgggtgaataataaacatgtgcccatttgaaaaatgttgtttccacatatctggcataatttgaatgactgaatactttaaagctatttggggaatgagatgatttccacactatggaatcatacacttcgcttagacaaggtgcatctttaccaaaatcaaaagattggtagaatacaataggagcaaatatgttttgagaacttgtttctgcttctaatataattttgatctctttattttctgtttctttattttggctaccatccatatcggcctcttctttggagcaagacaagacaaagaaggtaagtagtaaaaaacagtagaatatctttttcatgtttgtttttgagttgggtaaatagctctgtttgtaatgtcgaaaacaaagctagcaaatatatttgataatctcagctttgtatcctatattttatttttgactgatgatttgataatcaaaatcggtaaacaaagactttacagagattcaagaggttcctgcacatacctcatatactcctcatagtctatataccttccacccattgactttaagtgtggggtttcaaactgacaatcaatcaaggttcctcccaactcctgaaatgtttgtgccagatagataagcgccagtttcgatgcattggggactagagaaaacatgctttcgccgaaaaaacactttcccaaagtgactccatagagtccgccgaccagacaagattcttcccatacttccacgctggtcgcgaaaccttgctcatgcaggcggatgtaggctttcatgatatctttgcccaaccatgctcccgtttcttccatccgcagattgccgcaggtttgaatcacttcatggaatgcctggttaaaactgactccatattgttctttgttcataaaagtacgcatggagtgagaaatgtgaatctcgttagggaaaatcacaaaccgtttcaggggacaccaccattgtatctgtttttcacggaaagcataccaagggaatatgccattggaataggcaaggaggagacggtctacggagaggtcgccgcccactgccaatagtccgtccggttcgccatagtgagggtcgggaaaaacaagtttttgagttagttgaaagaccatattgttttttatttattggattcatataatatcttctgtagtaacttctccgtatctctgcctctgcggagaagttgccgattcatttaaaggtattactctttgagtacttgcaagctcaattctccgtttcctgctgtcactcttactttacctcctgtttttaatgttccgaataggatttcacgcataagcagtggcttcagctgcgaagtaattaccctgtccatttccctggcaccatattctttggtgaaacctagtttcagcagatgcttataggcttccgggctgagttccattcctacatgacgtgcagacagtttgtttttcagttcgttgagttttttgttcaggatgagagaagccattccgtaatccatatcatggaagacgactgttgcagacaaccggttgatgaattcaggtttgaaagttttcttaacctgtttcaacattgcctctccggcagtaatttgtccgctgaaacctatagaagcttggtgcgcgaattgtgctccggcattggaggtcatgataagtataacatggcggcagtccgctttccgtcctttgttatccgtcagtacggcatagtccatgacttgcagcaggatattgaatatatcaggatgcgctttttctatttcgtcaagcagtaacacacagttgggagttttgcggatagcatctgtcagcagtccgccgtcttcataacctatatatccggcaggtgagccgatgagtttggccactgtatgcttttccgtatattcgctcatgtcaaagcgttgcagggcaatacctagttcggaggccaatactttggctacttccgtctttcccactccggtggggccaacgaagagaaggctggccagtggtttgttttcgtccagtagcccggctttggccatttgtacggcttccaccacttggcagacagcttcttcctgaccgtatatctttgcactgatgcgttcatgcaaggtttctaatgtggcattgtcctcttccttcatggcgagtacatccactttacagatacgtgccagtatatcggttatcaatgctttgtccaccgtttgtgtttctgtatctgtggggtggatttcacgataagccccggcttcgtccaccaggtcgatggccttgtcgggcaaaaaacggtcgctgatataccgtgcggcagctgtgacggcatatgctatcactccttcttcataaactactccatggaacgtttcgtacctttcttttaatccttccactatgtggatagtttcttcgattccgggttcctgtatgtcaatctgttggaaacgccgtaccaatcctctgctacgtgaaaaatagcggttgaattcttcgtaagtagtggaaccgataaaccggatctctcctccttccaaataaggcttgagcatattagaggcatccatcgaaccgtctcccgtccgtccggcgcctatcaggttatgtatttcatctatatatacaatggcgtgtccttctttccgtattccttccataatggctttcagccttttctcgaattcaccccgatattgtgtaccggccaataagttgcctaaatccagttcgtagatacgacagcctgtgaggcgttcgggaacattgcctgcttctatacgtgcagctagtccgtagaccagtgcggtttttcccactcccggttcacccacgtgcagagggttgttcttttctttgcggcagagaacttgaatggtgcgttccaattccacattccggcctataagcggattccggtcttgcagaccttcattgagggaggtgacgtagttgcgccaaggttcgcttttctcttgctcagaggaagtttcctcttgaaactgattcatgtgctcgtaatttgaaatgagggagctgagaaactccggcatatcttctcccactgtttcttttagcagatagccggcccatgaatcttccagttgaagcattccttgtaccagatgaggaacatccatttcttctgcgcttgaatggctgattgtcatataggcatattgcagcagctcggagagttgacctgaaatttccaactcatattctatttcttgaggaactcgttccacttttttcgacagatattcggaaatggactgggacagttcttccggggtacaaaaacactctgccaatgctttttgaaaaggaacttgttccagcaatgcgctcaataagtgttcgggcgtgataaattcatgccgatattgcatcgcttggctctgcgcagaagcgaaagcgtagttcaccgaatcggtatttggtatatccatatcttattcttgattttttattcttcttccggtgtaaccgtgagtcggagagggaaaccctcttcacgagccatacgggtggctttttgtacttttgaccgggcgatatcatacgtatagatgcctattacggccgattcacttttgtgtacttgcatcatcaaagcttctgcttccatcgttgatttgaaaaaaacggtagttaatatctttacaacaaattccattgtagtaaagtcgtcattgaaaatagtaactttgaagcgtcgcggctcgcgaaggtctatacgttctttttctttataagatgattgttgttgttccatattggtatttgtcatacgtacttatggcacaaaggtagggaaagtattggaaaggtagggtagggaagagatgaattttgtagacggatggtctggagctgatgtcttgaattcctttcatgcctgtctgtcattcttaaaacatccatatataataagatgtttcaaggatgacagacgtgtatgaaaaataaaatgtgaaaaaattcaaggataagaggtggaaacttagacttttctgtgaacaaactggccgtcaatccaaatggtggcatggtttccccggaacttcagcaggatatattcggggtcttccggtcctttaggaaaatgatggataaaccagtcttgccataactctttcttggtgccagtgtctgatacaacttccacttctccggtcatggccacgctgtttccctctttgtagaaacatatgccggctttcggattagagcggaaatcctttgtctttgccgaactgtttcctgttgcaaaccagatggttgttaatccttccgttttgattttactcaagggaaccggccggggatacccttctttattgatggaagttagtgtgactacttcacattgttgaagcaaagcttttgctttttctttaagtgatcccattgtttctttttagtttttgatacggtacaaaagtaagaaacgccaggatggcttcgttgtaaaaaaacgacttttatagtttcagatatgttaatgtggtttcttccgtaaccggtaaggataaaaaggaaccgggtgtattgcctgataaggcttttatttccttactcaaatgggctgtgtcatagtatccggcctcaatggcaacagagaagagttgattggaagaggtggaacgcagtaaatccactgcattcttgaatttgataatccggctgtattccttaggggaatatccggtctgatgtttgaacttgcgctcgaagtgtctttggcacaagcatacattttctactaaagaacggataggcagttggcctttggaaaggttaatgcaatctactgcatatgatatctgtttttctatcttgttgttagtacataaggcttgggtgagaaaagattctatcagtctgattttgtcctgtatgtacggttgttcacataatctttctgctagcgagtcgttgaagatacctcctgactcaaaagtgctgattctttgattcccaagttcttccaatggtaattgcatgaagcggaataaaccgcaaggcagaaaacggataccaaacatatggatgcttttcgcataggttattagggtggagtatcggctcatgggacctacaaaataagagcggtagggttgcattataagactttcttgttccgctatgtcagctacttcgccaagggtgaagataaaatcggtgcaaccgtccggcaatatgttgattttcatcccatagtccggattgcctttaaattcccagtatttgtcaatatagggggctaaaagcagggaaggctggtattcattatacatgaagattgttatttctttttagcagcgatagctagtaatactcccagtaccacccctagaatggcggcaaataatacccgcatgtccggaggaagcaggaaagtgatggtgtgggccggataccagaacaaagggatggtctttttgaatacaaagctccaaagtaccgcccaattcaatccggtgaaaatacgtgtcatgggaataggggtggaaagcgctttgatagagccgccacaattcccgatatgagtgtctgttattttatgtaatgtcatgaatacaggagcgaatatagagttcattgtaacggaaatagccagtgcaaccagaaatttggcaagacagaaatccccgttcatcaatgtggaggcatattccagacccatatattccaagaaaatgggagtgccttttgaaaaaataatcatagccatattgatacccatacccagtaccccccagattaccatgcgtgggataataccgaaggtcttgttgtgatacactcctgtgctgatgcgaagcccaagcatttctcccaaagtagctagaatggcgaacttcacaaaactcatgaccataccatggattgcattgaaagatttgtaccattcataaatggtatcgctaataaaaaagggtagaaacaatgctattacaaacaaaaagaacagaatatcactctttttcatagatagaaatgtgtttttcattaatatttgcgacaaacatacgaaaaaaatctaagttcctaaccaaacaataatttaaattcgacggctctttatttgttatctagctataatcttttatctttgtttcccgtcatggaataaaataaaaaggttattatgaaaacaaaaggatggattttaactgtaatttgtagtatgttgttattggtggcgggtatcacttttgcatcaatggtgcttgtcgggcaaccggctttggcaaacgaatcattgtggtggtggatcttgataaatcttggtgtgatggttttattattcgggtatggcgtgaaacggggaatccagatattgcgtatcttcagcataccgaaaagcaaactgacacgggaaccaggtgtcgtggtttgtgattataatatcagcctgaaaaagtatgctttgtataaattgtgggacatccgtcatttcagtttctctttgttgttcatcatttatatttgtattgcactgtgtacagggcactatattgttcccgaagagcaaagcctgttcagtccgctgctgatttggttcttgtgtcttatttatatcttgattatgctgcctgtcagactaaataagatttataagcggagtattgcggggcagacttgggtggaaataactccggaagggctgacatatgataaggcggaactgaaacagacattcccttgggaggagatagcaggtatagctctttataagacttattgctttctgtatgataaaagaggcggtgaatttttgattgtaacttcggatgaaaaggtgaaagaatcccttctttactatttaaatacgaaaaaataatgaattaaagctaagtgttttttataataaggttgttcatattattataatgtgtatttttgtaacaaagtaataatgaaaaacctcttaagtatgaaaacacctgttctcgcgctattcatttctttagtggcatttggagcctgtgtgtccaataaacaaacccagccgtcaaccgattatacccaattggtgaatccgtttatcggaaccgattttaccggcaatacttatccgggagcgcaagcgcctttcggaatggtacaacttagtccggataacggtttgcccggatgggaccgtatttccggttatttttatccggacagtacgattgccggattcagtcatacccatttgtcgggaacaggagccggagacttgtatgatatctctttcatgcctgtaactttgccttatcaggaagcggaagctcctttaggtatctattccaaattctctcatgcggatgaagaggcttcagctggttattatcgcgtgttgctgaaagattatgatatcaatgtggagttaactgctacagagcgttgcggtatacagcgttatacgtttcctgaaggagagtcggctgtctttctgaatctgaagaaagcgatgaattgggactttaccaatgattcttatattgagataattgactcatgcaccattcagggatatcgtttttccgaaggatgggcaagagaccagcatgtgtatttccgcactcgtttctccaaaccgtttgcctcggtagagatggatactactgccattgctttgaaaggtaaacgtgtaggtacggcttatatcgcccgctttaattttgatacggaaaaaggagagcagattgttctgagtactgctctttcgggagtaagcatggaaggtgctgctaaaaacatggcggctgaagcacctcacaatgatttcgataaatatttggctgaaactaaagataattggaaccgtcagttgggaaaaatagaggtaacaggtgataacaaggacgataaggttaatttttatacagcattgtatcatacaatgattgccccgactatttatagtgatgtggacggggcttattatggtcccgataagaaaattcatcagacggatggttgggtgaattatggaactttttcattgtgggatacttatcgtgccgcacatccgttatttacttatacggaacctcagcgtgtcaatgatatggtgaaatcattcattgctttttatgaacagaacggacgtttgccggtatggaatttttggggaagtgaaacggatatgatgattggctaccacgctgtacctgttattgtcgatgcttatttgaaaggtattggtgattttgatgcagagaaggcattggaggcttgtgtggctactgctaacttggatgattatcgcggcattggtctgtataaaaaattaggatatataccttataatataaaggatgaatataatgcggaaaattggtcgctttccaaaacattagaatatgcttttgatgattattgcatagccgaaatggctcggaagatggggaggactcaattagcggacgaattctacaagcgttctcagaattatcgcaatgtgttcaatccggcgtcaagcttcatgcagccgatagatgataaaggagtattccaacctaatttcagcccggatgactacactgcccacatttgtgaaagtaacggttggcagtacttttggtctgtacagcaggatattaaggggctaattgccttgactggtggtaaggatcgttttacggaaaagttggatagtatgtttacttatatcccggctggtaatgcagatttgcctcttttcagtacaggtatgattggccagtatgctcatggtaatgagcctagccatcatgtgatttatttgtataataaggtacgtcagccttggaaaactcagaagtatgcggcgcaggtcatgcatgacctttatttcaatgcacctgccggactgtgtggaaatgaggattgtggacagatgtctgcctggtatgtattcagtgctatgggattttatcctgtcaatccggtaagtggtgaatatgagattggtacgccgttgttccccgagatacagatgcatctggataatggaaaaacgttcacagtactggcccctggagtaagtcgtgaaaatatctatatccagtcggtgaaagtaaatgggcaaccatacgataagagctatatcacacaccggcaaataatggatggtgctactgtagaatttgaaatgggtccggaaccgggaaatatttggtatagatagataataattggttcaacttattaagaattgtaattgtacaggaggtgagttaaaagtaatatttgttatcgttttgctgtagaggcggtttgaatctgcctgaaaattgtatgatgagcggaagctttctgcccctacagtggatgattggatcgttatttggaacattggctctctccttcatacaaaggtgaattatataatatgaacgaggaacttgatgacacctataaggtcgtctttcgtcaatgctatcctaagctgttgttctatgcgacacggctggtcggtaccgaagaagccgaagatgtagtgcaggatgtttttgtggagttgtggaggcggagagattcagtcgtcataggagagcagattttagctttcctttatcgttctgtatataccaaggctataaatttattgaagcatcagattatagagaataactacagtgcggcaatgatagagatctatgaacgaagattgcaatattaccagccggatcatgctgaagttattaaaaagatagagaatcaggaattgcgtcaggaaatttttggagcgattaatgaattgccggataaatgtaaggaggtgtttaaactgagctatcttcatgatatgaaaaacaaggaaatcgctgatactcttggcatttctttacgtaccgtagaggcacatatgtataaggccttgaaatttttgcgcgaacgtctcagccatttattattgtcattgattatattttcagcaaaactgctaagtgtttttacaagttgaattgtttactatatgaatagggaaaaagatgagtaaacttaacgaagatattattatcaggtatttggaaaaccgatgctcggaggaggattttgttcttatcaatgaatggatgaaagaatctgatgagaatgccggagagctgttccgtatggaggagatttatcagttaggtaaattcccctttgaggaggaaaatctggtagtgagggcagagcgcaggttgggtagaagattggaacaggaaaatcaaaagaaacaagaggtgttcaagcttagaagtgtgttgcgttatgcagctgctatagtgggcgtgatggtgctggctgcgggattagcctattggttccggaataaagcggaggaattggtggtagcatcggctgctcatggacaagtgcgtgagatgttgttgcctgacgggacaaaagtatggttgaaccagtcgtctgttttaaaatatccgcgtgcttttgaaggaaaggaacgtcatgtatatctggatggagaagcttattttgaagtagcacgtaatcatgagaaacctttcatggtaaaaagcccggcaatggatgtcagggtcttgggaacctcttttaatataaaatgtcgtccggataacagttttgcggaaacaaccttgatagagggtgaagttgaggtaaaagataaatcggacaaaggaagaattactttgttgccgggacaaaaagctgttttaaacagggtaacagggcggatgcaagtaaaacaggtcgatcccaagatggagatagtctggcataatgacttgattccatttgaaaagtcatctattttccagattgcggcagcattggaacggttctatggagtgaagataatcctttcaccggatgtagacagtactaatacttattcaggtgtactgaaaaagaaagataatatagagtctgtgctgaattctttgcgtaactctattcctttcaattataagaaagtagatgataacaatatatttatctcatcggaaacaaaataatttttaaataaagatctatgaaaatcaacatgctcttaagcggctgtcttctagggttattgtgtttcactgcatgtgattctgagggcaatgaaatgaatgattacacccattatgtcaatccttttattggtacaggaggccatgggcatactcatccgggtgctatggttcctcatggcatgatacagccggggccggatactcgtattgacggttgggattcctgttccggatattattatgaagatactacgatcaatggttttgcccatacacgtcttagtggtacagggtgtgcggatttcggagatttcctgttgatgccgactgtaggtgtgcagcgtactgatttcttgggaacagaaagccagaagcgtcctttcgcatcggctttttctcatgaaaaggaatatgccgaaccgggatattattctgtttttctggatacatacggggtaaaagccgaactgacttcgacagagcgtgcggcaatgcatcggtatacttttccggaaagtaaggagtctggatttatcttggatatggactataatattcagcaacaaatcaatcaggtaatggaagtggaggcagtgaatgatactgtgttgcgggggcgcaaacgcagtgcctattgggcataccgacaggatctttatttttatgccgtattttccaaaccctttacgtataccttgtacacggatactgttcaggaaaatgacaaacagattcctgtatgtaaaatgcttttgcattttgaaacggcgaaagatgaacaagtgctggctaagttctctatctcttctgttgatgcggaaggtgcttataagaacctccaggctgagatgtccggttggaattttgatggagtgcgtgccgatgctaagaagaaatggaatgaatgcttgtcaaagattgcagtcaaaaccaatgatgaagaccagcgtgccattttctatacggctatgtatcatgctttcctaagtcccaatctgtttacagatgtagacgggcgttacttgggaatggatttgaaagtgcataccaccgacatgaaacatccggtttataccattttctctttgtgggatactttccgtgcgttacatccgttactgactattgttgatcctcagttgaatacggagtttatccgttcattaataaagaagcatcaggaaggtggtatctttccgaaatgggactgtgtgtccaattataccggaactatggtgggatatcatgcggcttcgttggtaaccgattcttatgtgaagggataccgcgattttgatgtgcaggaagcttacaaggcatgtctgcgtgcagcggaatatgacactaccggtattgtagctcccgattggctgattccatatgttatgcccaaagcacgttattataagaatactcttggctatattccatgtgaccgtgagaatgaatcggtggcgaaagcattggagtatgcgtatgatgactggtgtatctccgtgctggcagacagcttgggagatactgaaaccaaggagaagtatgcccgttttgcagatgcttacgaattttattttgatcctgccacccgtttcatgcgtggattggatagtaaaggtgaatggcgtactccgttcaatccccgttcttccaatcaccgtaatgatgattattgcgagggtactgcatggcaatggacttggtttgttccgcatgatatcccgggactggtgaatttgatgggtggggaggatgctttcgtaggaaagctggactccttgtttacggtttcttcccagttggaaggggaggctacctctgctgatatcacaggactgataggccagtatgcgcatggtaatgagcctagtcatcacattactcatatgtataactatgtaaaccgtccatggcgtactcaggaattggttgacagtgtgctgtataaccagtatttcaatgctcctgacggcttgtcgggtaatgaagattgcggtcagatgtctgcctggtatattttgaattccatgggcttctatcaggtatgtcccggtaagccggtttattctatcggacgtccgttgtttgaggaggtgacgattaatttgcccgaccgcaagactttcgttatccgtacccacaataattcgaagaccaataagtatattgagtcggttttgttgaacggaaaaccgctggatgttcctttctttacccatgatgatctggtacgtggaggaatgatggagattaccatgagtcccgtaccgacggaatggggaaaacaggtgaagaattaaaagtataacttaacccaaatagcaatatcatgaaaaaactatttctatcagttgtagcgctgtgtgtcacgctgtttgtacaggcaaaggattatgcagactatgtgagtccgttggtaggtacacagtcttcctttgaactctctacaggaaatacttatcctgccatatcccgcccgtggggtatgaatttctggactccccagacaggaaagatgggggacggatggcagtatgtttatacggctaataaaatccgtggtttcaaacaaacccatcagcccagtccgtggattaatgactatggtcaattttccatcatgcccgtaacaggaaaaccggaatttgaagaggacaagcgtgcaagctggttctctcataaagctgaaattgcaaaaccttattattataaggtttatttggcagaacatgatgtcgtaaccgaaatggttcctacagagcgtgccgtaatgttccgtttcacttttcctgagaatgattcatatgtagtggtggatgcttttgatcgtggttcgtctgtcaaggtgattcccggagaaaacaaaatcgtgggctatactacccgtaacagtggtggtgttcctgccaacttcaagaattatttcgttattgagtttgataagccgtttacttatgaggctacgttctctaatgatgtacagcctgaaaaaccggatggcagtgttcctgtaaccttgaaagaaggtaaactggagcagactgatttccataccggagccgttatcggtttcaagacaaagaaaggtgaagtagttcatgcccgtgtggcctcttcattcatcagtcctgaacaagcaattcggaacctgaaggaattgggtggtgacagttttgaagtattggtacagaaaggtaaagaggcttggaatgaggccttaggtaaagtagaggtggaaggtggaacattggatcaataccgcactttctattcctgcttgtaccgttccttgttgtttccgcgtaaattctatgaactggatgccaacggacaacctgttcattacagtccttacaatggcgaaacgctgccgggatatatgtatacggatacaggtttctgggatacattccgttgcttgttccctttcttgaacctgatgtatccttcggtaaataaggagatacaggaaggtttggttaatacttataaggaaagcggtttcttccccgaatgggccagccccggtcatcgtggttgcatggtcggcaataattcagcttctatcttggtcgatgcttatctgaaaggagtatgtgtggaagatgtggaaacattatacaaaggactgattcatggaacggaagccgtacatcctgaagtttcttctaccggacgtctgggatatgaatattataacaagctgggctatgtgccttgtgatgtgaagattcatgagaatgcagcccgtacattggaatatgcatacgatgactggtgtatttatcagctggcgaaagagttgaagcgtccgaagaaggaaatcgcactttttgccaaacgtgccatgaactataagaacctgtttgattcggaaagtaaattgatgcgtggcaagcagaaggacggcaagttcgctcctgaattctcgccgttgaaatggggaggtgactttacggaaggaaacagctggcattattcctggtctgtattccatgaccctcagggattgattgatttgatgggaggtaaggaaatgttcgttaccatgcttgattctgtcttttcggttccccccatctttgatgatagctattacggacaggtaattcatgagattcgtgaaatgacagtcatgaacatgggtaactatgcacatggaaaccagcccatccagcacatgatttatctgtatgactatgcaggccagccttggaaagcgcaatattggttgcgtgaggtgatgaaccgtatgtatacagccggtccggacggatattgcggtgatgaagacaatggtcagacttcggcatggtatgtattctccgcattagggttctatccggtatgtcccggtacggatgagtatattctgggtgctccgttgttcaagaaggcgacacttcattttgaaaacggaaagaacttggtaataaccgcatcggataacagcgataccaaccgatatgtagatgaaatgcgtgtaaacggtactgtttataccaagaattatttgaagcataacgaattgttacaaggcggtactattgacttcaagatgaccgaccgtccgaatatgcagcgtggaacacaagaaagtgatttgccttattcattttcaaaaaacgaaaaagtaaaataaaagtttcaccatgcacttctctcttataaagagaggttggagggggatgttctcttttggcagcattgcaagagtacatcccctttttctttttaagtatttcttctatacgtcaaagtccgatgatattactacttttgcctttcctctgcttttttctggaaaatttagaaaaaagaacaagatggagtaagtgttttcttttagctgcctgttttttattctcgaaaggggaatgagaaccccttcactggagaaaaacaagtcagtgttaacgaatttataaattatgaaaggcaatcaattaatgagaaagcccaaattactcagggcgcttttgattcttttgtttgtggctgcacccatacaatggacccgcgcgcaaatcgttctttcaactcccaagacaacgcttggagcagtgatcaagaacattaaatcacagtctaactatcagtttttctatgatgacaagctggctgaaatgccggtgaatgccattgatgtgaagaacggttcattacagtctgtacttgatgcggctttgcaaggcaaaggaattacgtataagatagaggataacattgtctatctttcagcatccggagagcctcagacacctcaacagacaggacaggaacatacagtgaccggaacagtggttgatgcgacaggcgaagccttgattggtgtaaacgtacaagtgaaaggaaatcccacagccggtacgattacagactttgaaggtaactattctttgtccgttcccggaaatggtgagattgtgttctcatacattggttaccgttcggaaacattgaagcccgatggcaagaatgtactgaatgtaaccatgcaggaagatacacagcagattggcgaagtggtggtaaccgctttggggatcaaacgtgagaagaaaatgttgggttatgcggttcaggaactgaagagcgatgaactgaacaagacaggtgacccctcggtaaccagtgccttgcagggcaaggtggcaggccttcagatgaatacctcggctaccggtctgggcggctctacgaagattaccatccgtggaaactcttctctgacagacaataaccagccgttgtggattgtggatggcgttcctttcagcgacactagcacttcaagcgcatcccgctatgatggtgtggaccgtggtagcgcttccatggacattaatccggatgatatcgagagtatttctgttttgaagggtccgaatgcggctgctctttacggttcacgtgcaggtaatggcgttatcttgattacgacaaagaaaggtagtaagaaggatggtttcggaatccgttatagtggtaatttcacttggacagctatcggcgagacattggatatgcaacgccgttacggacaaggacatattgatacaaaagatgccaagactgcggtgtatgacaaaacggatagcggaagctggggcccggtattggatggaagcatgaaagaggcttggaacggagaaacgtacgcttactctaactatggggataagttgaaagattattttgataccggtttctcgcatacgcataacgtctctatcagcaacggtacagagaaatcacattttcgtacttctttcggatactccgacaatgacggtgtattccccactgaaagtttgagccgtgtgaatgccgatctgaatgcaggaacggaattgaacaaatgggtgtctatggacggaaaaatttctctttcacgtacaaaagccgataaccgtccactgtatggagattacggtgctatttcccagttgatgagaatccctaacaacgtccgtctggatgacttgaaacaatattctgatgaaactcatgcgcatgtgaattggacagggcctactgccagtatccgtaatccttattatgtattgcatcagcgtcagaattcggatgaacgctggcgtgctttcggatattatagcatgaaaatcaatttcactgattggctgcatctatctgccaaatacgcttttgactactaccgcaccagagtgcaaagcaccaatgcgggggatggtatcaatggagaagccaatacttccatgattacgaatgattcaatggaccgtagtgaagaaaacttcttcgagtcaaatgctgaagtcattttgatgggtgaccgtcagttgactgataacttccgtctgggcttcaatgtcggtggtaactttatgtaccagcgttcggaaactttgggcgtgggcgtaggtaatatggtggacaaaggtaactggatgctgaatgcggccaatttgttgagaaccggtagtgaggatggctacaagcgtgccatgaactcggtgttcggctctgtacagatggcgtggaaggaatatctgtctttggatttgacagcccgtaacgactggtcatccactcttccgtcaggtaacaattctttcttctatccgtctgccaacctcagtttcgtagtgtcggacttcttgcgctctatcgacaaaccgttgccaagctgggtgacatttgccaaggcacgtctgtctgccgcacaggtaggtaaggatacaagcccttatcagttatacaatacctactctttcaaattcgataatggtgtattgaccccgaccaaagacaatgtgaagatgaacgaccagttgaagcctgaaatcgcgacttcttacgaagcgggtctggatatgaagttcttgaacaatcgcctgggatttgattttacttattattacagcaagacaaagaaccagattatgaaagtacccgcagcagctccctggagtggaggacaatgggtaaatgcaggtatggtaaccaatcaaggcgtggaactgatgttgtattccactctggtagaaacaaaggatttcgcttttgacttgaatgtgaatatggctcacaacgtatcgaaggtgaaagaactggctccggaagaaaatgtgaactatatgttctttaacggtgacggaaacttccctgtaaaagtaggtacacgcgccggacacaaattaggcgagatttatgctacatcgctttataagcgcaatgaaaacggtgatattatcgtaaatgagaatgggttgcccatgactgtgaccaatgagtccgaatatgtgaacaaacctatcggtaatatccagccaaagctgaccatgtctgtatctcctacctttacttataaggggattacactgtccgcactgtttgatatgaaattcggtggtgatatcttctcttattccgagatgctggctaccggaaacggtttggctaaacgtaccttgaaccgtggtgaggaaaacaactatatgatggtatttcccggtgtgacagagtcaggcgaggtgaatacaaaacaggtgtccgcttcagaatactatggtgcattgcaggctgaggatttcatctacgatgcttctttcattaagctgaaagaattgtcaatcggctattcattcccctcatctatgctgaagaagactcctgtcaactcgctgaatgtttcatttgttgcacgtaacttgtgctatctgatgaagcacacaccgggtacaagccccgaaggtggctatgacactacgatgttctcacaagccattgactatgcatcgttgccgtttacacgtactttcggtatttctatcaacttaggtttctaattaattaaaaggaaaaactgattatgaaaatcaaattatataaatccgtagccttatgttcgttgctggctttggccggatgccatgattttgaggaattgaatacaaatccttacgcaccgatttacgacccgactgtggagaatgtatcggccgacggtatagatattgattatactttgacggaacatgccatggcaagtttgaaagggatggaaggtgctatcggaagtatttttgccaacttcacctacgaaggtccttacaatgattatcagacaacaaccaatctgactcatgatatctatgccggttattggggaaacaatgtcagcggctttgtgaatcaggcgcctacctattcttatacggatggatggtcggccagccgctggaagcatttctatgatgaccgcagcacttcggaatacagccagttggtcaagacattctatttctgcaataaggattattaccatacggcattctatatcacccgtatttattatgctttcttgttgtccatgcagacggacacttacggagatattcctgtagcctactatgtgaagggagccatgccaccggaagaaaatgtgacctatacacctcaaaaggaagtttataatatccttttccagctgttggatcaggcaataacagagttgcatcaggaaaatcttcctgctgtcagtcagtatgatttaggtgacaatgacaaatgttatgggggtgatgtggacaaatggcgtcgttttgccaatacactgcgtttgcgccttgctttgcgtgtatccaatgtagacccggctttggcccagactcaggcaaaggcggctttgacagatcctgccggtttgatgcaaagtcaggatgacaatatgaagcagactccgaaacgtcagtatatcgccggcggtaatgaaaatatctacgcgttgttgttcagttggaccggcaatgctgtattgtcgaaagaaatggaacgggcttataagaatcaggctttgaaagaaggtgcggcagccgatgccgttactttcaatgagaattctgagaactgttatctcgaccctcgttgtgaagttttatggttccgtcctactccgtttgattcgttgactaccagtccgcttcctacagagaatctgaagaaagatttcaacggagtgatgaatggagaaaccaatgtaggcggttcttatctgaacagatattctgccaaccgctgtattctgtcatctgatgccatgaacaaggattattggtggaatctggctcgtgaaattgtctggatgggttatgctgaaagcttgttcctgaaagcggaagcggcattgcgctggccgtcattggtggatgaaacagccgaagccctttatttgaaaggtatcaaggcatctatggattattatgaaattgatgcggacaaggccaatgaatacatcagtcatctggatggcgtaaaagcatttaccggtggtagcaaggaagaacagttggaacagattattactcagaagtggattgccgttttcccgaatggaaatgagggatgggcggaagtgcgccgtaccgactatccgcgttatctgctggctccggtcaatggaaacaattccaatggagaagtggcgtccggcaagcttatcaaacgcatcaactatcctaacagcgagtcccgtaaccccaataaaccgggcaatgtgaaccagggtagccgtgtatggtgggatgtggccgatacgatgaatgatagaggtcagtggcatactccgaataatttccgctagaaattgctatctttgtatcctagggaacataaaaagaaacaaaatgaagcaaattctatttttattggcagccgtcctgttattgggcggctgtgcggaagagaagaagaccgacgttcgttgggctactttcaatatccgttacgacaatccgcaggacagtttgaacaattggcaatatcggaaagaccgtgtgtgccagtttattaaggaccatgagctggatattgtcggtatgcaggaagtcttgcataaccagtttcaagatcttcgcgcaggcttgcccgaatacgatggtatcggtgtgggacgtgatgacgggaagacagcaggtgaatatgcgccgcttttctatcgtaaggacaaatatgaggtgttggactccaatactttctggttggccgaaaatcccgatagcgtaggaatgatgggatgggatgcggtttgtgtccgtatcgccacttgggcaaaatttaaggacaaggctaccggaaagatattcatggctgtcaatactcattttgaccatgtgggtgaagaggcccgccgtcaaagcgcattgctcattatccgtaagataaaagagatcgtaggcgaacgtcccgcagtggttacgggcgactttaatgtgaccgatgcgagcgatgcatacgaaacaatcaccaccaacgagtttgtgatgaaggatgcttataagacggctgcccgtgtgaccggcgttgattatacttttcatgattttgcccgtatcccggccgaggattgtgaaaagattgatttcatctttgttactccgcaagttctggtgaagagttgtgaaataccggctgaagtaccggaagctttactttccgaccataatcctcagttggctgacttggaattctgattttttaaataggtgaacttacgccggtagagtctttaaaagggctttatcggcgtttgttattttattctgttgatacttctcattatatgtaatcttctcccatttaaaataattttcctccttcgataagtgtgataccttacttaattgttctatatttgtatcattaatccaatttaatagtatgaagacatacagttactatgtattatttttgttagttgtgttttgcggatgttcccgtcccacggaattaacatcgccggatggcaatataaaattagtattcaacctgaatgaggcaggagcgatgacctatggagtttctgtaggaggaaaaccgttcatcactccttctgttatgggctttgaaggtcgtgacgggctcaatctctccaaagattttcagatagaaaatactgagtttaccacaaagaatgaaacctggacccagccttggggggagaataaatctatccggaaccattataacgagatggctgtgcgcttgaaagatccggcgaatacacggctgaccctccgtttccgcgtgttcgacgacggtctgggctttcgttatgaatatcaagtaccccaagtggacagtgtgttcgtgatggacgagctcacttcattcaatctggcgcaggatggcaagtcatggtctattcccgccagttttgaaacctacgagttgctgtatcgtaccctgcccgtcagcaaggtggataatgccaacaccccgatgactttcaaaacagataacggggtatatgccagtattcacgaagcggctttgaccgatttccccgaaatgactttgaagcataccgaaggttgtcacttcaaatcggaactggcctcctggcccgatggggtaaaagcccgttttgccggaggaactttcgttactccgtggcgcagtatccagatagctccccaagcggtaggtctgataaactccggcctgatactgaatctgaatgaaccttgtgcgctggagggtgatttgagctggatacgtcctatgaaatacgtaggtatctggtggggaatgcatctgggggttgaaacgtggacgatggatgaacgccacggcgctaccaccgctaatgccaaacgatatatagattttgctgctgccaataacatagaagcggtgatgttcgagggctggaatgaaggctgggaaagttggggcggtatgcagacttttgactataccaagccttatgccgatttcgatatggcagaggtggcacgttatgccaaggagaaagggattgaaataatcggtcaccacgaaacgggtggcaatatctttaattacgaacgccagctggacaatgcttacaaatggtatgcagacctgggagtgcacagcgtgaagaccggttatgccggaggactgccgggcggtcacagccatcatggacagttcaatgtacgccattaccgcaaggtggtgcagactgccgccggttatcatgcaaccgttaatgcccacgaacctatcaaagatacaggaattcgtcgtacttaccccaatatgatgacgcgcgaaggcgcccgcggcatggagtggaacggatggagtgaaggtaatccccccgaacatcacgagttattgccgtttacccgcttgctgggcggtccgatggattatacaccgggtacttttgatattctttatgaaaagacacgcaattccccacgccgcaagaagtggaatgacttggataaaggaaacagccgtgtgaataccaccttggcaaagcagatagccaattgggttgtcatttattctccgttgcagatggcttcggatatgattgagaactatgaagggcatcctgccttccagttcttccgggattttgatgcggactgtgactggtccgaagccttgcagggcgaaccgggagagtttgtagctgtggtgcggaaagcgaaagataaatatttcctgggagccaccacgaatgaagagtcgcgtacactcaccattccattggatttcctggagaaagataaaaaataccatgccgtgatttatgctgatggagaagatgccgactggaaaacgaatcctacttcgtatcagattaaggacaaagaggtgacagcagccgataccttgtttgtagtcatggcaaaaggcggcgggcaggcggtgagctttattcctataactgactgatttaccaaatgcttcgtcctattgcgtttatagattccgaaaggtaacttcatctccttctgaaaggggatgaagttatcttcggttatagccgaattcaacaaccttaatacttagatataaatgaaaacaaccgaaaccccaactccggccagacgccgtagtcctattttttgggttcccaccgcttatttcggtatggggctcccttttgtcgtattgaatatggtagccgtacttatgtacaaaggcttgggagtaagcgatgcaaagatagccttctggacttcccttatcatgcttccctggacattgaaacccctttggagtccgttgctggagatgtaccgtaccaagaaattctttgtcgtcctcacccagatggtgtcgggagtcactttcgggttgattgccttgtcgcttcatcttccgtccttttttgcaatcactatcgccttgttcgccattgtcgcctttagcggggcaacgcacgatgtggcctgtgacggggtatatatggacgagttgaatgcacaggaacaggctaagtatataggttggcaaggtgctttttataacgtagccaagattatcggtacaggtctgctggtctatctggccggtttcttgaaagatgaatacgaaggtcctgccgaagatgcggtactctattcctggacggtcattatgattgtcctcggaggagtgatgttcgctttgggactttatcatacccgtatgctaccttcgggcaagcatgcccattcggtcacctctttttcgcagagtatggccgagttatggaatgtcatccggaacttctttactaaaaagcatatcgtttattacatctgctttattattttatatcgttttgccgaagggtttgtgatgaaaattgtacctttgttcctgaaagccggtcgtgatgtgggcggtttgggattgacagaacaggagattggcatttattacggaaccttcggagcggcagctttcgtactcggttcattgctgggcggatattatatttccgcacgtggattgaaaaagactttgttctccttgtgttgtgtattcaatctgccttttatggcttacacgctgcttgccattttccaaccgcagagtgcgcctcttatcggcggagccattgtgctggagtatttcggatatggcttcggctttgtggggcttaccttgttcatgatgcaacaggtggctgccggccctcatcagatggcgcattatgcttttgcatcgggtatcatgaacctgggtgtcatgttgcccggtatgatgtccggatatgtcagcgactggctgggctataaactgtttttcatctttgtgctggtggctgccattccggcattcctgatgacttggtttgtacccttcacgcacgaagacaagaaatagagaaaaactattaacctaacaaaaaagagaatatgagtgaattgaagattgcgggcaatccgttgcccggtatgccgtgggaggaacgtcccgaaggttgtaaaaatgtaatgtggagatgtagcgcgaatcccatcattccccgtgatttgctgcctacatccaatagtatattcaatagtgcggtagtacctttcggcgaagggtatgccggagtgttccgttgtgatgatacaaaccgccggatggcgctccatgtgggattcagcaaggacgccgttcattgggacatcaatccggagaagttgcagttccagtgtgatattcctgagattggtgaatgggtgtacggttatgacccgcgtgtctgctttatcgacgaccgttactatgtgacctggtgtaacggatataagggccagcccaccatcggcgtggcatggactacggatttcaagacattccatcaggtggagaatgctttcctgcctttcaaccgtaatggcgtgctgtttccccgcaagatcaatggtaagtttgccatgttgagccgtcccagtgacaacgggcatactcctttcggagatatttattatagcgagtcgcccgacttggagttttggggacaccatcgtcacgtcatgtcacccgcgccttttgaagtaagtgcatggcagtgcctgaagattggcgccggccccattcccatcgaaaccagtgagggctggttgctgttctatcacggtgtgcttcgttcctgcaacggttatgtctatgcctttggatcggcattgcttgatttggacgagccctggaaggtgaaattccgttcgggaccttatcttatctctccgcgtgaaccttacgaatgcatgggtgatgtgcccaatgtatgcttcccttgtgcggctttgcatgatccggcaacgggacgggtggccgtttattatggttgtgccgacacggtgaccggtctggcattcggttatattcccgaaattatagaatttaccaaacgtacttctattatttaagcaccgtttgtactgttctcattcgaaaacagaggatgtgttctgtggctgtcacttcggtccggacacatcctctttgtctttttccgggaaagggaactgtctggttataaagcggcttttaagtgctgtcttctctttggctaagcgttttcttccggatgattaagggcttttatactgaaaccttctacagtccattgcaatggactgtagagtctgtcgtaatggactgtacggtctgctacagtggactgtacggtctgcaccggaagactatagaagataataggaataaagaccttagttgtatggagaaaaaggcttatgtttgctgttgaaagaggttaggttccgatacggaaagacatcagaccggtataccggcaaattattcacaggcagtcctctgcctctcgatttttctctttatctttgccggaaaaataaagcagtccatgaaacgacccaacgtacttaatttaacctgccctgccatccccgtagttcggatcggttttgtcggattaggaaacaggggcattcttgcacttgagagatatatgcacctggaaggcattgaggtgaaagcgctttgtgatttgcggaaagagaatatagagcgtgcagagcatatcttacgggagttcggccgtcccgaagccgagaactattcggaagaagggatgtggcgcaagatgtgcgaatgcaaggagatagacctcatttatatttgtacggactggctgactcatactgatattgccgtttatgccttgcagcagggccgtcacgtggcgttggaggttcctgccgccatgagtgtggccgattgctggcggttggtggatacagccgaagaaacccgccgtcactgcatgatgctggagaactgttgttacgatgcatttgccctgactacattgaacatggtgcagcagggggtgttgggcgaaatcactcatgccgagggggcatacatccatgacttgcgcaagcattattttgcagacgaaaaagcgggtgggtatcacaatcactggataaagctttacagccagcagcatacggggaatccttatcctactcacggcttgggtcctgtctgccaatggatgaatattcatcggggagaccgtatggagtatctggtttccatgtcctcgcgtcaggccggtctgtctgcttatgccggacaggtgtttggcgcatcctccgaagaagcggcgcagagttatgagatgggggatgtgaataccacgctgattcataccgcaaaaggaagaactatcttgttgcaatatgatgtgaccactcctcgcccgtacagccgccatcagacggtgtgcggcacgaagggattcatgcagaaatatcctgttccctgtcttctgctcgatgaatatggcaaggaacctttgtccggtgagcagtttgagcggatgatggagcagtataaacatccttttacggcagttatcggcgaggaggcgcggcggaagaatatgccgaatgagatgaattatatcatggactaccggcttattcattgtttgaggaacggtttgccgttggatcaggatgtgtatgacgccgccgaatggtcctgcattacggaactgagcgagcgttccgtgcggcagggcagtgtaccggtggagattcccgatttcacacgagggaactggaaagagagatagtgctgtcagttctttagcacaggggggataaactgaatggttctcacctgaagatgaaaagaacgctgatatgttaatctccaggtgaaaatacaggcttgtttattgaactcccattgatgttatcgtttcttgtcttgtggtgtttccactattatttttccttctttcatggtgaactgtgcgattttcaaatcattcagggcgtccagtacggtattcaccgggagttggcggttgatatggaaatagatgcgttcgtccagtaacggacgtgaacggaatacgatgctgatgttataccatgaacctatatcttgcatgacttgcctcaagtcggtattgtcaaaagaaaattcattctccgcccatccttttctcttctccgtatcaactcttttcaattggagttttccttgtttatccaaggatatttgttcccccgggtgcatttccttactttgattgcgcttggtatgacttacattcactcgtccttgatagaggatgacatccggcgagtaacggggatatgctttcacatcgaacaccgttcccagtactcgtgtttgtagttgctcggtgcatactataaaggggcgggaagcgtctttggctacttcaaaacgggcctctccgcttagtttgatactgcgaatggtatctgtaaactcctttagatactccagacggctgtttgcgctgagcaataccttgcttccgtcgcttaattgaacggaggtaatggtagcgggcggggtgcttacaattatccttttcccttcttcccgaaaagtaatttcctcaggaacttccagtgaagtgaagacttccacttcctgcggctcaggttgcaaaaaaggctggaatacaagtaccaaggcgatgacagcggcagctatacctggtatcgttatccgtcggatagattggtgtctgatacggtgacgacggatgaatgtctgccaggctttccgggtttcgtctgcggtgggaatatcccccaatgcttcaccaaagagttgttccaattgatggtcattccaagttccgttttggggggagtcttggttatggggattctttccgttgtccggatggatgtggtcatttgttgaaaactcctttttcattgtttatcctcctttttcagtatcgcttcgcgcagagtccgcaatgcttttgatatatgttttttcacggtgtcggggctgattcccaattcgtcggctacctgttgatatgtttttttctcccaatagcagcttcgcaagatggtgcaagtcggttcgggcaaactgcgggctatgttttccgcttgctgcaacagtgcctcgtgtgcgcggtaaccctgattcatttccgcacgggtggcttcgatgaggcggtctatgtgttgctgttccacattcaaatgcttcaagcggttgaggcatccgttacgcacggtggcatagagccaggcgctacgggtgttttcctttagttggtcgaactccttccaggcttgttccatggtttcgcttactatgtccttggcttcttccgtattgctcatcagggtggtagcaaagcggacgaggcgtgggtacatttctgcgaacagtcgttcgaagtgctcttctttatggtttcttctcctgaataaaatctgcatgtttccttgtcttccgtgaacaaaggtacggaaatttccttttctccgctggggttacagacgattcttttcgctttgtccggctccggttcctttatatttgctcttggtggcattgaatttataggatacttggaggccgaagcgttggaaatcccggtaaatccgattttccatataggcatctatgccgtataaatcaaaatggaaataccctgttctaagaatatcattggcggtgaatgttatggtgagtgtctcttttaaaaaggatttggaaaggcgtgcattgatttgtccttccgtgcgcgttacaaaaaatccttgccgggaagcggtggagagatatccttccatattgaagaaccagcctttgggaaggttgaagttgttgtccagactgatatagaaacggggttggttccggtgttcggtgattcctattttattcgcattcatgtccaaaaaagccatattcacattgagttgtggttcccaacaccccagtttgggagaggcattgaaactaatgccgtaattatgggttgtaggaatggtctgtgtggcaaataagaggacgcccggatgtgtatcttccttgtatggcataattatattggtatacatattgagaatacggctgaaataggctgagaaatagagccaattccaagaggcgccggccgaaaagcgatgcgtcttttgggttttcagcaaagggtttccttgagaatactcatatttgctgcgatagcggatggaattggtcaataggctataatcggggttatttttacgtaaccggtaagagaggctgaaacttttgccattgtgtgaccaactggcggccaatacaggaataatatcattataggtagggctttgtgcatctatccttatccctttttcataataatctgtttgttgatgttcataacgtattcccatattcagtttccaatggcggatggatcttgaatagtcagcaaatgcggcatatacggattgtttgatgtggtcgtcggcatcggcagagaaaccgttttgggtaaagatatcatggcggttggtaaaagtttcttccgtaccgaatgaaaaacgtccgttccataaaggggcactgactaccagcttggcggcatagagggagctgcgcatgcgactgtctgcttgcacggttgcatcgtcattattcatggcgttctggtcggaatgcgagcgtttgaacaggtaatcggcgttgaagtcaatattccatttgcccagttctcctgcgtagtaggcgtttgccgcgtgatcccaacctgtatgtatttgttctgctgtagtaaagtttatccggtcggtttcttcatcgttacgtctggtgacggttttaccggatgaatttctgtctgcattccctattccggtttcgggcatatagcgcagaccgaaagaatggtgttcatccggttcataattgaatcccagctcaccggaaaaacgttggctcttatgggtctgcacatcatttttgttggtttgccaaatggcggaacccttgatgcggttcatatttgtggtttttccatacgagttttgctgtgccatatatccctttacaaagagatccagaccgccggtgcgataatttaatgccatatattcgttggcgttggcggaatgtccttgtgaataagtcgtattgaagtggccgctcaacccttgtccgcgccggcggatggtgcggaggcggatgacggctgctacgtccgaggcatattctgctccgggagtggtgatgacttctgcggataagatttcgttggcccggatacggtccagttctgtcatgtcacgtactttcttattatttatatagattacaggagaaccgcatcccattacattgtattcgccgttatggccggtgacgaaaggaagatggggcaacatttctgcggcagaccccattcgggccagggaagttcctgccacgttggcttttagtccgttgggacccacttctatcatggggcgtcgggcgctgatggttacttcctgcatcagttgggtgtcgggaagcaggtgaaacgtaagagtagggtggcaaggttgcacttccgtcttatagcctatataagaaacccgtatcaagtaaggtatcccttcttccgctatcatcaggaaacttccgtcttcacgggtgacacatccgtttacaaaggtggagtcgccgggagtcaataagagtacattggagtagggcagcggttcattcttttcattggttacttgtcctcgtatttcggtaatgcgtatgtctcttccctttttctgtatggcgaagtattcttcccgttctttacaaatgaaaggaatgccgttcaggacagtgccgatggcttcaagttcggttttttgccggatggaggctgtaacccggtagctttctgtttcgttataggagaagataatattctttccgccttccttttcgattagtttaagggcggcgggaagtggtttgtcctttaattctatagagaattgccggggtgtttgtgaatgaagcggaaggatgatgctgaataatacggtcatgatccacgctgttttcaaatagccgtctgatctcattttactagtgtttaattgttctttatgagtaatacaaccgaggtttgtaatcgggtacggtaaaataaggaaaaagattcgatgggttgtcggaatggattcccgtggttggttcatgcgaagggaacggatataactttatgaagaatttatgaaggattggaataagaatggttcattgtaatggcttgaggttcaaaacattgtccgcgtatgaagaatttgaaggaaaaaaggtggaaaatgtgttttgaagagatggttggggcagatacttgtgtgatacttgttttatgaaaattgtagatggcagtagctatgaagaacagagggaataaaaacaaggtgactgaaaacaaatccagccaccttgtttttattgtttaacctgtgttttattctatctcgacgctatgttttaccggagtcaggatgaaagtaaattcataatcaccgtagggcaacatatattgaggcaacggcagagctccccagctgtttacacaacctaatcccatctgagccttgtcgatgatcaggttggtcaggtctgctttctgtacttcgggcgagtgacgctggtctttttgttcgccatcatccagtgaacagatggtataatgcaaagcggatgcagagaatggagcatcacctactaccttcagtccgttaccgccggcattcagttgcttccaccaacggatatcggtcttggttcctgtttcctgcggacggatataggagtagaattgttcatccacactctggcgataaatacccaagtcggtgctgtggttgcggtcactgtagttttctaccggaccacgaccataatattctacggtttcaaaacatttaggcatctgcatttgcataccgaagcggaacatcggagatactttggcattcttgtcggctgtcatcttttgggtcactttgatggctccttcgttgttgatgacataagtcagatataatttggcggaaacattcttcatgtcatattccgcattcactactatctggtcattttctgtcttggaattcaaggaaaccagtttcaatcccgggtttttccatgcggcatatctgttttgcaggccggctcccatatcattgtctgtcggggcacgccagaagttaggggtcagggctgcgccttctttcagcatttccgttccgtccactgcatatttgcttaagtaaccgttctgtttgttgaactcggctacgaagttattgccttttacgatcagataatgatattggttgtcgatgatttgcggaacaacggtggctacattggtcgtttccacgttcttcaaatccatagacggtgctttgtaatcattcagtgtcaactgattcttggcgacggtgaaacctgcgggcagcaaaccttcgcggtttttcagtttgtagaaaacgttcagcaaccattccttgcaggtgcaggtcttgccgatattcaacgtaatcttggctgtttcctgaggagcgacttttaaatcatccacgcgtccggtgcggattacttttccatctttcagtacttgccattccatatagtaggcggacaggtcacggaagaagttctcattgaacacatttacttcccctttgcttaaatcggcgggagtagtccagatattctggtaaaagtgacctacttcatacatgtgcggattaggaacacggtcggggctgatcaaaccattgtcacagaagttattgtcagaagcgtcaaaacggttgaaatctcctccgtaagcatagatcatcacgccgtcttttcctttccagcggcaggactggtcaacgaaatcccagataaatccaccttgcagattcggatatttacggatcaaatcccaatattctttgaaaccaccctgcgagttacccattgcatgggcatattcacactgaatcaatggtttggtagcatcggtacgttgaccatatttttccatgccgttataatcatagtacatcggacagaagatatcggtatgttctttctggcgtgcttgttcatattggcaggcacggctggggtcttctgctttgatccatttatagcattgttcgaagttggggccgtcaccggcttcattacccaatgaccagaagatgatgctcggatggttgaatccgcgttgtacattgcgctggttacgttccagatgggctttcttataagaggggttcttggccagcgtcttgtcgccgtagcccataccgtgagattctatattggcttcggccacgacgtaaataccatattggtcacataaatcgtaccataagttgtcatccgggtagtggcaggtacgtacagcgttcaggttgaattgcttcattatctggatatcctgtagcatacgttcgggagatactacatagcctccatccggatccatttcgtggcggtcggcccccttgaacaggactgccttaccgttaaccaagatctggtcacctttcaattcaatcttgcggaaacctactttgacaggaatcacttcattgctgccctgcatgctggcacgcaaggtatataaataaggtgtttcggcactccactttttggggttctctacgttcatggtcaccagaccggatttgttggcggtagcggttgccacttgcttgccttgtgcatctaccagttccaaatcgactttaccactgcctttcaaatccagattgacagccaggctgccgttttggtaagctgcgtccaagtcgggagttacacggatatcttgaatgcgttttttgttgcgggcatatagatagcagtcacgtcccacgccgctataccggaagaaatcctgatcttccagataggtaccgtcgcaccagcggaatacttggaaggcgatcaggtttttctgacccggttttaaatatggagtcaggtcaaattcggcttccagtttgctgtcctcgctgtagcctacataacgtccgttcacccacaaatacatattggaggtaaccgaaccgaaatgggcgataatatcttttcccttccatgaggcgggaactacaatttcacggcggtaagaacctacatggttattctctgtcggcacttcgggagggttgttctggaactggttacgccaggcatagcctacgttcacataaataggatcaccgtatccgttcagctcccatacggcgggaacttgcaggtcatcccagcctttgtcgttgaagccggttttccagaaatcagtcggacgggagtctgcatcctttacccagttgaacttccaggttccgttcaaagtcatgtagttagttgattgttttttgtctgctttcttagctgcatctgcattctcaaaagcaaagtagttcgtgtgcatcggcgcacggtttaccgcatttatttccgggttgcgccattcttggaaggtctgtgcgcctgctgtaagggcgaggactgtgaacagacctgtcataagttgtttcttcatgctattattttattggttttgtgcaaatatagtgaaaataatagttaccgatgggacataaatcgggcaatatttgttataattgtgaatgatttgtgttctatcctaaaaaattatggcatttctgaggcgtatttggagtaaatggcagaatttactgcatgatgagaaattaaagcataaaatatatgtgattatttttgaaagcgacacaccgatgggaaagttattcgatgtggcgttgatagggttcattgtcttgagtattctggtggttattgccgagagtatcaagagttgggataccgttatcgggccttatctgcgggtgtcggagtatgtttttactttcttttttacgttagagtatgtgttgaggctttattgttctccccaaccgcggaagtatgctctgagttttttcggtatagtggatttgctggctaccttacctctatatataggctggcttttcggcacggcacgttatctgctggtgatccgcactttccggttgattcgtgtgttccgtatctttaaacttttcaattatctgaatgaaggtaatttcttgttgcgttccttggtgttcagcagtcggaagattattgtttttttcttgtttgtactgatattggtgacttcgatcggtacattgatgtatatgattgagggacagcgtccgggcacttctttcaataatattccgaatagtatttattgggcgatagtgacgatgacaacggtaggttatggggatatcactccggaaactccgctagggcgcttcctttcggccattgtaatgttactgggctataccatcattgcagtccccacaggaattgtttctgcgtctatgatccaggaacatagacgcagggtggccctgaaatgtccgcattgtggtaaggacggacatgaggacggggctgcttattgtaaatactgtggaggaaaactggtaaattgattatggaatgctgtatgatagaaagttattctatcacccatcgcttatcatgcgccaccgtctttttcggatcataagtcattccttctttggtagggatttttatcacgtaagtccgcccgctgtggttggacaaggatgtttcccgtaaccagggattcatattctttaatatggccagattgattcctttgctgcgtgcgaaacgtgccaagtctgcaattcctttcgtcacagtgatttccgtataaggaataggcggatacaaatccgatgcacgcaggcggaaaccgaaagtagtgggggcattgaataattgtttggcggcaagaatgcggtacacataccgggcagtctcttctaccagttgcaaatccaacgagtcgtccacatcctgtttggccagttggctggcaatgcgtgcctgaccggcattgtaagaggcggcgacagccacccagtccttatattttgcatacgcgtctttcagatagcggcaggcggcacgggtcgctttctcaatatggtaacgctcgtccacattgttgtttacctccaatccgtaatcccgtcccgtaccttgcatgaattgccatagtccggcagctccggcagaagaacgggcggtgggattcatattactttctattaccatcaggtacttaaaatcatcaggtattccgttttctttcagtatgggttctacaatggggaaatagcggttggcttttttcagcatttgcaaggaagtactgtgcatataggtgaatgccaatagttcacggtccatacgctcgtggcggtcaaagcggctcaaatcaatggttttgccacagaactcaatactggcgggaacttcgggactactgtatttcaatgccgtaatacctgaatcttcccgtatgatagtggtatcttcctgctccgtttttggagtagcgcaactgctgcttactaaggccggtgatgcaactacaatgcaaaaggctgccacagcagccagattgatggttatttttctcattttttctttattcgttttcattctctttttcttttccgccccgtccgaagttacgatattcggtaggggtgaaattggtacgctttttaaataccgagaaaaagtgttcagtagaggtataattcaattcataacatatctctttcactgacatggaactttcaatcaacagctgcttcgctttgcgcagtttcagctcttggaaatacttggcgggcgcataaccggtgtattctttgaatactttgcggaaccaggaataactgattcccaatttcatggccagttcttccgggtctatatccttgtacacattttcgtgcatgatgattttggcactttctattttttgtgccgcattgtccacctcatagcgtttgttctgcgagatagcaagtacggctcccataatgtgtaaaacgatgccggacaaatattgttgcgctgcggtcttgtctgcttccgctacttccagtgcacgggcaaaaagactggccagttcttcattgataccgatatccagaatctggctttcttttgagataaagctgttttttaccagattgtctataatcgggccttcaaaaccgatgtaatattcgttccatcctgtcttttgcagcggcgcataggtatgccactgtccgggaaacaggaaaagtatctgccctttggatatgtcgacagacggggttgtgtcgctggcgaaagttcctcgtcctttagtgatatataccaactgatattcatgcagcacacgtcctttctgggctgtgaaataataggcgtccgggtggttgcgtggtggataaacgcttccggccctgatagcctggaatccgacggtagtcaccgacaagccgaaacgcttgtcacgctcattgacaattaggtatttaaaatcagcgccttggtcgttgtaatgcatgtttctctgttttaaaattaggtcacacttatcggcaaatatacaattttttatcttaacagcctctaacctttttgttctaagtgtttctggaagtataattttagtttcttatgtatgcaaatgggggaaatttagaacaaatcttatggaatatttgcttaaaatgcttttttttgcgaatattgcatcaaatcttaaagttgaatctatgcacttggcacaccgtaactgcgaatatattcttggagtaatatatctttttgtttttcctgttttgctttgggctgataataaggtgaatacttatcattttaaatccatttccacttcggtgaacttccctaccaatgaagtcaggaagttatttcaggatagccaggggtatatatggatttcgacctacaatggtctcttgcgttacgatggttattctattgttgtatataaacccgatggagtgaatcatggacgttccattgatagttttgtgaatatggtggccgaagacaaggagaataatttgtggataggtacgcacaatggattatacgtgttgcataaagaaacggatgagatagagaaaataatcagtcctttgttacaggtaagcaatgtagaaagtatcctttatgcaagtaacggagatttatgggtgggaagcaacaagggattgtttcgcagaaaagccggcagccgtactttcgattgtgaaaaaaacatggatataaagtctgttgtcgaagaccggaaaggtcaaatatggattggtacttgggaacaggggctgctgcgttatagtcctcaagaggaattgtattatacttacgacgggattaaccctggtaattcggcgcatgtcatatttcaggatgaagccgggaatatttggatcggtacctggcggtatggactggtgaaactcattaatccgtatgattcggaacatttctcatttaaaacattccggaacatcaagggaaattctcattctctgttggataatattatctacgccattgctcaggataaaaattccgggaagctctggatcggttcacgcagtggggtcagtattttggaagatgaatcgggagacgggaattttaccaatattgttccgggcaaccttcaaggagatttaccttttaatgaggtgaactctctgttgtgcagtaaagacgggctgatgtggctgggtatgttgggaggaggtgtttgtactgtaaatacaaataagttccggtttaattatgattctttggaggctttgcgtgagcattgccctaccagctctgtccgcagtgtctatcaggaggataatgggaatctgtggatgggaatcatgggattcggtctggtattttatgatatgaaacagcataccattgttccttaccgctctcatcctatattgaagaatatgggatatacatcgacggtcaatgatattatttatcgtaaaaggacaaatgaattgtgttttgccacttgggatgatggagtgtggttctataatgtcaaagccgggaaagcacacgtgataaataccgttaccaatccggagctgagtgatatttgtatttattctttgttggaagattcgaaagggaatctgtggttggggacacgttcgggagtgtttatcttggatacggaatcaagacttcattctttgaatgaactggtgactttgacaaatcaggcattgccccaaatttctattttcaaaatggcggaagatcaagatggctttatctggatagcgactagtaatgaaggggtatggcggatagatacatccggagaaacatataaggttaagttttatacgccttcggatggtacattatccactgtcggggcgatgagtgtttgtgtggatggatacaacagagtatgggtggggtcgaatggtaacggactcgatttgtatgaccggaagaatgatcgttttgtttcagtcttgaatgattatttccggaatggagatgttgttttcagcatgctggaggatgatgagcatactttatggcttactaccaatgcggaaatgtatcacattgatatacctttggacggtgctgcaccgaaaatacatacctatacggtagatgatggtttgcaagaccatatgtttaaccggaattcttgcttcaagggggcggatgggaaacttttcttcggaggattccgtggattgaacagtttttatcctgataaaatagttcaggatactgcctattctccggtagtaattacagatataaaggtacataatgtatcggtacgtacctatcctctttccgtcagagaggggattgctgcaaacagagctattgattttattgataaaattgtattaggataccgggagaataatttcagtcttgatttttcaatattgaactatatcaatcctgagttgaaccgttatttatatcggttggagggatatgacaaggaatggttgtccgttgaggctggacgtcggtttgcctattataacaatcttccggcaggtacttatactttttgtgtaaagggagccaatcagaatggaatctggtctccggatatgaaatgtctgcgtataactattcttccgccgccttggttatcgtggtgggcttattgcctttatgtcttgttgttcgtttcattggcatggtatacttatcggattgtcagaaaccgtatccggatgaaacaggccatagagatggggaagatagaacggcagaaaatggaggaaatcaatcatgctaaattacagttctttaccaatatcactcatgagttgctgactccgctttctattatatcggcttcggtggatgaactgaaacaagaagtaccggcaagttcgtcggtttgttctgtaatagctgataatactgtgcggttaatccggttgattcagcaaatcttagagttcaggaaagtggagaatggcaagttgcggctaaaagtttcgcatggaaatgtcagtatgttcttgaaaaaatcagtgtcggctttcgctcctttggttaaaaagcagaaattgtccatacaatttgatttgtctgaagaatattcgggatattttgatgtggataaattggataaagtggtgtacaatctgctttccaatgccgctaaatatactcctgaaggaggaactattgtggtgtcgcaggctcatgatgaggaaaagaggacttttaaattgagtgtgaacaatcccggcgagttgattccaaaagagaaattggatcatatgttcgagagattctatgaaggggagtatcgtaaattccataccatagggacgggtatcggtttgtcgctgactaaagatttggtattgttgcatcatggaacgatacaggtatttagcgataaggaggaagggaatacttttgtggttgaaattcctataggacgtgaggcttttgctgaagatgaggtagacgagaatactgaaaatgtggactatgctgttttatcggcagatgaaatggagaatgtctcggagattgatatgttggaagagaaaccggcagcatcgactattttgttagtggaggataatgaggaattattggctttgatggttcgtctgttgcatggcaaataccatattctgaaggccgctaatggaacggaagctttggagatccttgccaaacaggaagtggatttaattgtttccgatgttatgatgcccgaaatggacggtatggaattgtgccgccgggtgaagactcaatttgagacctgccatattccattgattttgttaacggccaagactagtgatgaagaccatgtggaagggtatgagtctggggccgatggttatatctgtaaaccgctccgcctctctgtcttgtttgccaagatagataacttgttgaaacggcgcaaacgtatgggggtggattttcgtaagcagttggtctttgaagccaaagaattaaattacacctcgatggacgaagctttcattcggaaagcggtggattgtgtgaatgcccatttgagtgattgtgattttgaacatgcacagtttatggcggagatgggtatggcccggactacactagcagataaattgaaactgttgaccggacttactccctctgcatttatcagcaatgtccgtttgcaagcggcttgtcggctgatagacgagaaaaagaaaatccgtatagccgatttggcgtatgccgtaggtttcaacgaccctaaatatttcagttcctgctttaagaagaaattcggactttctcctacagagtatatgatgaagtatgatggctgattattaccggaaataggctctatagggaataaacagcctttttccggtaataattctccctgtttcttttctgttcctcttacttttgctggcaaataaaacgaattatctttatttgttagacctttaaaaaaagtattatgaacatgaaaactctgacagaaaccagtacattccgggtactgagtctattgctgtgtctctgcttcttcatccctgcgatgaatgtgagcgcttccagtctgcaagcagacaagtttaaagtttccggtattgtaaaagatgccacaggcgaaccggtcatcggtgccagtgtggttgaaaaaggaacaaccaatggaacggtgactgatttggatggtaatttcaatctcacggtggcttctaattctactattgtcatttcttttataggatattccgatcaggaatatcgtatttcgaaagacaatacggtgctgaatgtaaatctgaaggaagatacggaaatgattgacgaagtggtagtagtcggttatggcgtgcagaagaaggaaaatctgacgggttctgttgctgctgtaaatttcaaggatgtagcttctatgccggtagcgaatactgccaatatgcttcagggtcgtttgccgggtgttatgttgaccaacaatggtgcccaggccggtcatgacagtcccgaaatccgtatccgtggtgtaggaacttttgaacacaatgatccgatggtcttgatcgatggagtggaaagctcggtaagccagattgcggaaatccctgcagatgatattgaaagtgtttccgtattgaaggatgcggcttcggcttctatttatggtgtacgtgctgccaacggggttattctggtgactaccaaacggggcggtgagcagaaacctaccattacatattccggtagtatcgctttgcaagaagctaccgtgctgcccgattatgtgaattcttatgaatgggcgaagatgtataacgaatgctggccttccaaagcatacacggatgaaatgttacaaaagttgcaaaacggatcagaccccgatcattttgccaataccgattgggctaaggaaatgtttcgtacagcagccatgcaccaacaccatttgtctgtgaacggtggtagtaaagcggtacattacatgatttccactcagtatttccagcaggatggtatcttgcgtgaaacggccaatcaacgttttaatttccgttccaatctggatgcacaattgggtattgtaaaattaggtctgaatctttcgggaagccgtcagaacattgatgagcctactaccagtgttaccggtgaaggtttgatgcgctaccttacttggtttacccgtcctactgttcctgtgcgttattctaacggacattatggatttttggatggaaatcccaatatttcccaatccgtattcaaaaatccgattgaagctttgaatatgggctataaagataacaagcattatcgttttgatggtaaattctttggtgaaattgatatcataaaaggattgaagttccgttcaagtctggcttataaatattatatgaacgatgtgactactttcaatccgaagaataatataagatacgatgctgaaggaaatgcgctgaccacagtcggtaccaataaactgacagattatcattatctggaaacgacttatattaatgaaaatattctgacctatgatttttctgtaggaaaacattcgttcaatctgttggcaggccattctatccaggctacccgttgggacaagaatgaggcgtccaagcagggattcgctaccgataatatttatgaaatggatggaggtactatgaatgaccatgtgaccggatcagcggaagagagttccttgcagtcattcttcggacgcttgaattataattacggaggccgttatctgttagagatgaatgtccgtcacgatggttcgtcacgtatgcccaaggcacatcgttatgctaccttcccttcattttcgggtgcatggatcatgacaaatgagaaatttatggagaatgtgaagttcctccactcattgaaattgcgtggtagctggggtaaattgggtaatcaggaaattggtaactatgcttatgcggctacattggcggctagtggcagttactatttcggtgatagcaaacagattggtatgaagactgccaagatacctaatgagaacattaaatgggaaacaactactattacagactttggttttgatgctgctttttggggtggaaagatcaatgtcacttttgactggtatgagaaaaatacctcggatattttgatgaagctcgctatgccgggtattttcctgggatctttggatgctccttatcagaatgcgggaaaggttcgtaaccggggttgggaactggctgctaattatttcgatcagaaaggtgactgggcatggcaggcaggtttctcgctttcaggtgtgaaaaatgagattactgatatgaaaggggtagaagacattaaggataatacgatcaatcgtgaaggtgaagccatcggctcttattatgggctgaaagccatcggtatctatcgtacccaggcagatttggaccgtgtaaatgcgaacggacagaagattctgcaaaacaaccaggaaccgcaattaggtgatatcatgtatgaagatatagacaataatggtaatataaatgatgctgaccgtactattatcggaaatccgttccctaaaatgcagtattctttcaatctgggattctcttataaagattttgatgtcaatacattctggcaaggcattgcaggtgtatatcgttataattgggatgaaactactatttccaacggtggaaacaagactagccgttggttggacagatggtctgaaagtaatccgaatggaagcatgcctcgtttgggaggaactattaataataactattcttcattttggttgacaaaaggtgattatttgcgtctgaagaatttggaaatcggatatactttcaggcaaagagagtttttgaccaagttgggcgttcagagtatcagactctatttggcaggaactaatttgcttactttcacttccttggacgattatgatcctgaaaaactgagtacagattcccgtaatgatgtacatcccaatacaagaacttattcatttggtgttaacgttaaattttaaaagcaacaactatgaaatcaattaataactttatagggctggctctgttgtcaggagctttgctgacttcttgctctgacagctttttgcagagggactcattgacagaatcttcatccaatacattttggcagacgccggatgatgctttgatggcgttggcatcttgttatgatgctttgcagagcaatcagctttataattccgaccaatattcattgggccctttatatatggattgtatatcagataatggcgggcattttaattggagtggctggatggaaggttatgatatggctatgggaattcataccccaagttcttctatcattggcagttattggaaagattgctatgaagtgatcagccgttgtaatgtgctgattgctaatattgatagagtggatatggatgcttcccaaaaggcgatttatcaggctgaggcaaagaccatacgtgcattgatgtatataaacttgactatgacgtatcaggatgttcctttcctgaccgcccctttgaccattgacgaggctgaatgtgaaaagacggaccgtgcggctattgtggctcatgttatgactgatttgcaggatgcggctgaagtacttccgcaaaatgcgtcttcacggggacatatcaccaaaggagctgctctttccttactggggcgtgtggctttgtataatgaaaaatgggatgacgcgattgctgcttataagcaggtgcaaggtttgggatactcgcttgatccgagttatgccaaactgtttactcaaagtggagaaacttctcctgaaatcatttttgcagtccgttatgaaggaccgggtatgagtgaaggtgctgcttttaatgcgcattggaatactccgctggaagcaatgaatggtactatagatttggcagatgcttattattgcaaagacggtaaaccgactaccgatacgaagatagccgaactgaacggtgggggtggcttggatgtcagcaagcctaatcctgctcattttgagaatcgtgatccgcgtttatatagcactttgtttgttcccggtatgctttggaacggtaaaggaggtatagatacttcggcttcaaatccgtatgccaatgtatatggcggagctgccgcttctctgtctaccgtatatgtttataagtattttgatcctacggatacttctaactcttgggataatggacaagacttttatgtggtgcgttatgccgaagttttattatctttggcggaggcgatggtacagaaaggaggctatgtttatagtgatgtaactgctttggttaatgaagtgcggcaacgtgcggatgtgaacatgcccacagtagaggaagtggaaggcacttctctttctaaagatgaattgttggaagtcattaagcatgagcgtcgtgtggaactggcttttgaaggtttgcgtttgtttgacctttatcgttggaaggaattggataaggcggtagccaatatagagaatgaacgcactatgtatggcttggcttatgaagcacgtaagttcaacggtgagagggattatgtatggcctttgccgactgccgaactggatactaacaagaaactggttcagcacgacttgtggaagtaatgtggagtgcaggttttcatcacagggtacacggactgtcacaaagaagtaggaggcaaataacctttaaatcaaaaaactgtgtgaatttgcgtaatctgtggtgaagcctggttgttctgacaacttctggaataaaattgataactttttaaaaacggaagagaaatgagaaaaacaatgatccttcttttattttccttcctgttggcagcatgttctgatagtccagtgtgctattatctggatgctaccggcggtgatgataataatagtgggttagccccggatgaagcatggaaaagtctggaaaaactacgtggtgtgaaattactgccgggcaataaagttttgttgaagcgcggtgaggtttttaatggcgaacttgaaatcaccggacagggtatacccgaagatcgtatttatatagatgcttatggtgatggtgaacggaaaccttgcattgtgggatatgatacttccttgtatgcagcccgtatctgtaattcggactatataacgatgcagaatttggaaatcgtgaatacaggcaggcagcctctgccttatcgttcgggcttgaagatagagtgtatggattatggcgtatcgcagaacattgttgtcaataatgtgactgtacgggatgtcaatggttcgttggtaaaagaaaaaggcggagggtgcggtatttatatagtgaatggcggtgaaaagaaaatttcaacattcaataggttaaccatagagaactgccatattttgagatgtacccgtaatgctatgatttgggctgcttatagcgaccggcagaactggcatcccagcaagcataccgtgatacggggaaatttgatagaggaagtaccaggggatggtattgtacctatcggttgtgacagtaccttgatagaatacaatgtaatgcgtgactgtcctgatatgcttcctgacacagaggcggcagcaggtatttggccgtggagttgtgataatactttggtgcagtttaatgaagtaagtggtcataaagctccgtgggatgcacagggatttgattcggattggaattgccggggaacggtcattcagtacaattatagtcatgataactatggtggcttggtattggtttgcaatgacggcacggccgacgcatcttttaatgtaggtaacttgggcactatagtccgttacaatgtgagtataggtgacggagtgcggcctgaaccgactcgtgccgggatgttctcaccggctgttcatctggcaggtcctgtaaaggatagtcgcattacccgtaacattattcatgtgaaccgtaaacctgcggctgatatcgaccgtactatgattactttggattcatggggcggatatccggatagtacatttattagtgggaatattttttatgctcccgaatccagcagattccagttgacagaatctacacataatttctttgaaggcaattattaccttggccggttcgagaaattacctgaagatggtaaagcctgccaatcagctgaaatttatcagaaggaagtactggcaaaggatgaaaacggttatcagggcttggctttgttgatggatacggtggaagtgaccggagtaaaaggagtttttgtcaataaggaagccattgagaatttctttagccggttagagaaataagtaaataatagctgtaatttaatgaggggagcaaaactaaaatgacctgatcatatagtgcgataggttgttttagttttgacatctcccttttttatttatggttcattctttcttctttagatctatttctccggagaaagaaatagattgtctgtttgtgggggtgacctgtatgttactgctgccattgggataaatggtgatattgtaaaggtaattgtcttcctcgttccgtacttttagtgtgattttagcatttccctttttgctatatgttgaagtatattctgataaaggagcactaaaatttaatccttttccacctccgtaaggaacgttatacgccactccgaaataaggcagataggaatataccgaatcgtttcttatttctaaagaataatcggaagtcaggtgtttgctgcctcctttcataggcattacccggtccacattgattttgtatgcctttgcgtcaacagcctcgcgtactgcttgttctctttgttgtttcttctctttcttgttctgagccgttataggtatcatactgcctgatagaaggagacttgccaaaaggaataatttatttgctttcatatctctctgtaggtttagtgaatctgtccttgccaaagatagccaaaaagaatactcattgttctgaaaaaaacataagataatcaaactgtcaatgagttaagtacgcgatttatcttttgagtcccgataataaaaaagatgatttgtccccatgcggagtcaaatcatctttaaaatctccccattaggggaagactataaaatattatttgggtagattaaaagccacactcatttctttcatctgttcctgactcataccgtccggctcaaatcccatattcttggcagcgatgtaaatcaatgcggatttatttaaaacatcgatttggtcgaatgcggccattacgtcacggtcaacggcaaaaatgccgtgtttttcccacataacgacatcataatcggctagttccttgatggttgcatcggctaattctacagaactaggcaattgataaggaatcatgcccaggccacgcggacagaatgcttttgtttcaggaatcatactccataacaggttggttgccacatctttttccatgaactttttgttgtgagacagggcaatcagttcgatggggtgtgtatgcacggatgctttgtaaggagaacctatgctgatgaggtaattgtgtacgctcaggtgggagggaacttccgaagtaggttgaaccggtttgtcggcaatgatgacatagctggcacagtcatccaaaatacggatgacagaaccgttgtccataggccaacgcgccaaatcccgcatacgcatattggttcctttgcaataaaaataacagcctttcaagtgaggcagtgttacaccgatttgttttacttcgctgatagcgggcatctgacggatttcatcgtctacatattcggtgatattgacggtgatattacctccgttacgttcggcccatcctttttgccacaaatatccggctacttcggctactttattcacctctttggccaattcagggcgattgtctaagattgatttcatatcttttttatttgattgttcataggatattgttattcatctttttcattctgaataacagtatgctacaaatatagtaattcttttaaaataaattaggaaatacgagagaaaagataagaactaccagtccggttatcagaacagtgatagtccgggtagatacgcctttccattcttttaataaaataccccatacgttactgaaagtaacattcaaagccatcaatatacaccatgagaaagctagcagtacaggactttcggtcaggaaacttttacccatttccaaaccgaagaattgcatataccacagtactcctgccaaagcacagaatatcaagttatttccccatacattgcttttggcataatcactcatggttttgttggctatattttgttgcagacagtaaaccgcattggtcaaaaagcctcccaatgttactaggaagattacgggaagtcctgcataaagcccttctacgcctcctgccaatgcagcttctttgatgggcgttccggcatcgagtcctaaagcgaaacaggcactcatcacacctgccagtagggctaccaacagtcctttggtcagagcgaaatcttttactgccgcgcgtttttcttcttcgctcatgtttttggcgcgaagactgccggcatatcctataatggcaatacccgacaaagtgatacatactcccagtaaaagaataagtccgtttccttcaaacaggttggttccggcaaaaatggcgggaaaaagtgtgccgaatccggcacaggtgcccagtgcgatactttgtcctaaggccactcccagataacgcatggaaagaccgaaggtgagaccgcctactccccataatataccataaaagatgctcatcggagcacctcctgttccccaaaggtcaaataaactgcttccttgagggatacctagcaacgcacccaataacgggaataccagccaggcaaatacaccttgtagcagccagaaactttcccaactccattctttcactttttttataggtacgtatgaactggattggcagaaacttcctatggcgatgatgattaatccgataatgatttccattgtttatattcttttaggctacaattatgttcccggtaggggcagcacttgaggccgcccctacggaagacaatcttgtagttggatattgattagcgtttcgaagtgacttctgcttcgtatttctctacttctgcaatgaactcttcgcctacgggtacattgttcttcaagcagaacatatcccatacagcattccaaggcaaagctttttcttcttcgagcagagccagacgttggaagccttgtccgtttgcttcatattcgcgcagtttggcaatcggttccaataaagcgcgtaccatacatttttgagccgcgcggctgcctataacgtatgcaccaatgcggttgatggaagcatcgaagtagtcaagtccatagtgtacacgatccaaggcgttgcaacgaacgatttcgctgaataaatccatagtcgggtcgtccatgatggttacatggtctgagtcccaacgtacggggcggcttacgtgcagcatcagttcggggacatacaacaacaaggaagaaactttgtcggcaacactttctgtcgggtggaaatggccggtatccaaggtaatcattttgttgttcttggcaccgtagccaatatagaaatcattagaacctactgtatagctttccagtccgataccgaatacttttgattcgatacagtctttcatgttcttatattctgttgcgaaaatctgatccagagagtctttcaacaaagcacggtatttcatgcggtttacagtgatgtctttgctgccatcgtgtacccacaggttcatgatacaaggatcgccctgggctttacccatctcttcggctacggcacgacaacgtttggtgtgctcaatccagaagttgcggataccttcatcgggatttgataaagacaagtcaccgcttttaggatgagagaatgaagtagagttgaaatccagtttcatgttgttttccttaccccattcaatccagcttttgaagtgttcgggttctacttcgtcacgatctacgacttttccttggaagtcgccataaatttcgtgcagattcaaacggtgagtacctggtatatatgaagctgctttcagaatgtctgcacgtagttcgtcgatgttgcgggctttgccgggatagttacctgtagcctggataccaccggtcaatgaacctgcctgaacttcgaagccggttacatcatctgcttgccagcaatgcagtgacagatggaaattctgcatggtttccattactttttctgtgtcgacacctacagcggcataacgttcttttgcgatctcatacgctttattaatcaattcttctttcatgatattatttgtttgtttaatgaataaatttcaaggtgaatattaaatatcttctctataatgagctaaatacttcttatatgcttcttcccattcttctgcttgctggggctcaaaagaaacggtttctatggaagtgctgattagttggcgcatagccgcgatatcgcttaccagcccgttggcttttgcctgtaacataatgttaccgatagctgttccttcactgggacctgctataacaggtacgcccactgcattgcaagtgaactggtttaacagattgtttcgtgagcctccaccgataatgtgcagcttttcgatggggaacggggccatttgttgcaaatagccgaatacttgtttgtagcgcagggcaagactgtcgaatatgcaacgggtgatttcgccataactctgtggtacaggttggttggtttctttgcaataatgtccgatggcttgaatcatagatgtcggattggagaagcagggggcatcgggattgatgagactgcggaaagcgggaactgtcagagcggcatctatcagttctgtgtaagaatagttgttggttgcttcccattctttgcggcaacgctccaacagccacatgccacagatgtttttcaggaaccgggtagttccttccacacctccttcattggtgaagttctgttcaaagctttccttatttataatggcatctttcacttcaattcccatcaggctccacgtaccggaactcagataagcgaatctttcgttttgtgctggtacggcagccacggctgaacctgtgtcatgaccggcaacggcaatgactggaatagctcccagacctgtgattttctgcacttcttctgtcagtactccgataggctctcccgggaaaacgaaacggccgaactgttcttccttgatatctgctacatccagcagttccttttcgaagcgtttggtgcgtggattcaacatctgggaagtagaagcgatggtatattctgttaccattttaccggtcagcatatagcttaaggcatccggcataaacagtattttatcggctgcttccaaggccgagcaatgattgcggtggagtgttgacaattggaacaaggaattgaaattcataatttgaattccagtgatgtcatatactcgttcacggggaatatgggtaaaatattcttcaggtgcacctgttgtgtgagggtcgcggtagcaataaggattgcggagtaactctccgtctttgcccacgaatacgaaatccaccccccaagtatcgataccgatggatcggataggcagattgtctttggctaccactttcagtcccctgataatttcattgtataaggcgtaaatatcccaataacaatgtcctccggtttctataatatgattagggaaacgagtcagttctttcaactccattttgccttctcccaggcaacctaagatggtacgtccactggtggcacccaggtctaccgcaaagaaataagtgtgttccatgcctttatttttgattttaaggaattaatagtgatgcaaaaatagtttattccccgaaagtcgtccttgtttttttgatattataactgttggatttggttgtacctgccgtaaaacataatattaccgcctttttaagaagatcgcattgaaaagaagaatttggtgtgattttggtttactcttgggatgatggataagagctttattgaaaatatgcataaagtcgcaaaaatattctcttttttgtatctatattcccgaatattctgtaattttgcagccgaatcagaataattatgcagtatgaagagcaagaatagcagacttgatgccattaagattattatttcgagcaaggaagtaggtagccaggaagagttgttgcaggaattggcgaaagaaggattccgattgacccaagctactttgtctcgtgacttgaagcagttgaaagtggcgaaagcagccagtatgaacggaaattatgtatatgtattgccaaacaataccatgtacaaacgtatgactgagcaacattcggccagtgagatgttgatgcataatggatttatttccattgaattttcggctaatctggcagtaatcaagactcgtcccggatatgctagtagtttggcttatgatattgataaccggaactttgatgaaatattgggaactattgctggtgatgatactattatgcttgtcattcgtgaaggctgcacaagagcgggagtgaagaatgcgctttcattgattataccgaatatacaataaaataatatagataaaaaaggaaatggatgctaaacaagtggatgtgatggtggcagatgcctcacatgaagtttacgttgataaaattttagatactattagagaggcggctaaggtacgcggaacaggcattgcagaacgcacacatgaatatgtgactacaaagatgaaagaaggaaaggcgattattgctttatgtggagaggattttgcaggatttacctatattgagtcatggggaaacaagcaatatgtagcaacttcgggattgattgtgcatcccaattatcgtgggatgggcttggccaagcgtataaaggcggcttcgttccgattggcacgtctgcgatggcctaaagcgaagatattcagtctgaccagtggtgcggcggtaatgaaaatgaatacagaactgggatatgttcctgtaactttcaatgaactgactgatgatgaggccttttggaaaggttgtgaaggctgtatcaatcacgatatattagtggcaaagaaccgtaagttctgtatttgtacagccatgctttacgatccggctttgcacgaagaagacactatttaataaattaaaaattaagaattaaaaattaaaagatggctgcgcgttcatgtacttatttctcagttttcaatttttaattctcaattaaaataatatcattatggaagaaaagaagaaaaaagtagtagtagcattcagcggggggcttgatacctctttcactgtaatgtatctggctaaggaaaaagggtatgaagtgtatgcagcttgtgcaaacacgggtggtttcagtgaggagcagctgaagcagaatgaagagaacgcttacaaactgggtgctgtgaagtatgtgacattggatgtgacccgggaatactatgagaagagcttgaaatatatggtattcggtaatgtgctccgtaatggtacttatcctatttctgtaagttctgaacgtatcttccaagggttggccatagcgcgttatgctaatgaaataggtgcggacgctatcgcacacggctcgactggtgcgggtaatgaccagattcgcttcgatatgacttttctggtattggctccgggggttgagatcatcacattgacccgtgacatggcattaagccgtcagcaggaaattgattatttgaatgaacatggttttgccgctgactttacaaaattgaaatattcttataatgtaggtctttggggaacttctatctgcggtggggaaatattggactctgcgcagggtttgcccgaaagtgcttatttgaaacaggtgaccaaggaaggaagcgaacagcttcgtcttacatttgaaaaaggtgagctgaaggctgttaatgacgagaagtttgatgatcctatcaaggctattcagaaagtggaagagatcggtgcaccctacggtatcggccgtgacatgcacgttggggataccattatcggtatcaaagggcgtgtaggattcgaggctgctgctcctatgctgattatcggagcccatcgtttccttgaaaaatatacgttgagcaagtggcagcaatactggaaagaccaggttgccaactggtatggaatgttcttgcatgaaagtcagtatctggaaccggtaatgcgcgatattgaggcaatgttgcaggaatctcagcgtaatgtaaacggtacagctatcttggaactccgtccgctttcattctctactgtgggtgttgaatcgaaagacgacctggtgaagaccaaattcggtgaatatggtgaaatgcagaagggatggacagcagaagatgccaaaggctttatcaaagtgacttctacacctttgcgtgtttattataataaccacaaggacgaagaaatttaataagtatgattaaagcaggaattatcggtggggcaggttatacggcgggcgaattgattcgtctgctgattaatcaccctgatgtagacataaagtttataaacagcagcagtaacgccggcaataagattaccgacgtacatgagggactctatggtgaaacggatttggtttttaccgacgaacttcctctggatgagattgatgtattgttcttctgtacggctcatggagatacaaagaagtttatggatagtcacaatgtacccgaggatttgaaaatcatagacctcagtatggactaccgtatcaagagtgatgaccatgacttcatctatggtttgccggaactgaaccgtcgtgctatctgccatagcaagcacgtggccaatccgggatgttttgccacttgtattcaattgggtttattgccgttagccaaacatctgttactgaacgaggatgtaatggtaaatgccattaccggaagtacaggggcaggggtgaaaccgggtgctaccagccatttcagctggcgtaataataatatgagcatctataaaccgttttctcatcagcatgttcccgaaatcaagcaatcattgaaacagttgcaaaacagctttaatgctgaaatagattttattccttaccggggtgatttcccgcgtggtatctttgctactctggtagtcaaatgcaaggtggaactggaagaactggtgaagatgtatcaagactattatgccgaggattctttcgttcatattgtagacaaaaatatagatttgaagcaggtggtgaacaccaacaagtgtttgattcatttggagaagcatggcgataaactgctggttatctcttgcattgacaacttgttgaagggggcaagcggacaagcggtccataatatgaatctcatgttcaatctggaagaaaccgtagggctgaggttgaaaccgtctgctttttaataaagaagagtttatgaaattatttgatgtatatcctctttttgacataaacattgtcaagggaaaaggttgtcatgtatgggatgatcaaggtacggaataccttgatttgtatggtggtcatgcggttatttctatcggtcacgcacatccgtattatgtggaaatgataagcaagcaggttgcacagttgggattttattccaattcggtggttaacaagctacaacaggaagtggcagaccgtttagggaaactttcgggttatgatgattatcaattgtttttgataaacagtggggccgaagctaatgaaaatgcgttgaaactggcttctttttacaatggtcgcaaacgtgtgctttctttttgcaaagcatttcatggacgtacttcactggcagtggaggtaacccacaatccgaaaattatagccccaatcaatgacaatgggcatgtgacttatctgcctttgaacgatatagaagcagctaaagcggaattggcaaaaggagatgtctgtgcggtgattattgaaggtattcaaggagtaggcggtattcaggttccggaagtgaaattcttgaaagaactgagtaaggcttgcgaagaagtggatgcagtacttgttttggatgaaatacaatccggctacgggcgtagcggtaaattttttgctcaccaacatgcaggtatccgtcccgatatgattacggttgcaaaggggattggcaatggctttccgatggctggtgtcctgatcagtccgaaattcaaacccgtatatggacaattgggaaccacttttggtggtaaccacctggcttgtgctgctgctatcgcggtgctggatgttatgaaaggtgagaacctggtagagaatgctgccaaggtaggtgctcatctgctgaaagaattgaaacaattcccacagattaaagaggtgcgtggcgaaggtttgatgatcggtatggaatttgacgaaccgattaaggaactgcgtcagcgtctgctgttcgaacagaaagtatttaccggagtcagtggtacgaatgtaatccgtctgctcccgcctttgtgtctgactatggctgaggctgatgaatttattgaacgctttcgtaaagtgttggtataagctggagattcaagagggataataatcagcgaaagaaaataaggtctcgtcaggaaacatttcggttccggcgagactttttgatttcatcttcttcaaagtaattttatttttagcttttcataatacgttcttctccttttttcccttatctttgtagctatagacttaatctttaataatatgaaagtagcaattattggtgcgggaaatatgggaggggccattgctcgcggccttgcccaaggcactatcattccagcgagtgatgtaacagtagccgatccgttcagcggaagtctggaaactctacaggcggattatccggagattaatgtgacaacggaaaatccgaaagcgataaaggatgccgatatcgttattctggctgtaaagccgtggttgatagaccaagtgttgagtgtggttcatttgactccacggcaagtattggtttctattgcaggtggtgtaactttcgaacagctggtaaagagtgtaggtccggaacagaccatattccgtttgattcccaatactgctatttctcagttggaaagtatgactttgatatccagtcgtaacgccagtaaggaacaagaacaactgatgctggatatctttaatgaattaggattggctatgcttattcctgaaagtcagatggctgctactacggctttgacttcatgtggtatcgcatatgtcttgaaatatattcaggcagctatgcaggcaggtattgaattggggatctatccgaaagatgcacagaaaatggttgcccagtctgtgaaaggagccgcttccttgatattgaataatgatactcatcccagtgtggaaatagataaggtgtgtacgcccggtggtatgactatcaaggggattaatgaattggatcacgaagggtttgactcagcgatcattaaagcaatgaaggcttgtctgaaatagaagcaacctcatggaaatgacgtggataacacggttctcgtttttgtgtattgtgttatctacgtttttatagaaggtacttttgcaggtttagtataaaaatatgctcacttttttgtttccgatttcatatttcatgttatctttgctatacaagatcagatctaatgtgaaagagaaatatgataaacacagaattgttcaaagaagtgtcacctttgtcggccaaggattgctttattttgatagagcgtcagaaatcgaattttaattttcctatacatatacatcccgaatatgaactgaactatattgagaatgcaaaaggcgcacaacgcattgtgggagactccatagaagaaatagaagaagaggaactggtgctggtcaccaatcctcaattggaacatgcttggagggattataacaacaagccgcagaatatccatgaaataaccattcagtttcattccgatctgctttccgaccagattctgaacaggaaccagatgatcagcattcgggaacttttccaccgtgcccgtaaaggaatcgtgttcagcagggagactatcgcgaaagtccgtccgttgttgaaaacgctgtcttgcgagaacgatagtttctattccttgataaaactgcttgttattcttcatgaattatcattggacaaagggatgcgtgagctgtcaaccgggcagtttgccattaactctgtttccaaagagcatactaacgagaagttgaacaaggtgctggattatgttcattttcatttttcggaagtgatccgtcttgcagatgtggctaaaatggtaaatatgagcgaggcctcattctgtcgttttatcaaacagcatacttccaaaagttttatcgatttccttactgatatccgcttgggggccgcttcacgtgctttggttgattcttccttgtcaatagctgaaataggatatgattgtggctttaataatctatccaatttcaaccgtatctttaaaaagaaaaaaggagtgactcctaaagagttccgtgataattatcgtaagaacaagactatcatttgaaaggttcggccggaactttctcatggacttgtctgattttgacagcactaaaagaaagcggattttttggaaattcggggatgttgtaggatttgaatgcctgggaataatgttccgtgtctttttgcggtactacgaacggcttgtaagttttttcttctttattcggatagccagaacaaggcttctcatattgacggtctctattttgataaaatatcataagtatatgttcggatagtattggtttgtctgtcggtaaatttccatctttgcctttgggttacaacctggtaaaactttgaatactaaccttaaaaaagacaagtgtcatgaaaaagctatcttacctttttgccgtggcggcttccgccgcttgcctctgtgcctgtaccgatgttaccgatgttcttccggcagaacaaatcccggccgatgcacgtagtaccttgggggccgacgtagttcttcagtggaacaacgaagaacaaaccatcgatggttttggtgtggcgcaggccggctggtccgactatctttatgcccaccgcaagcgtcaggagatcatggatgtgatgttcggacaggacgggcttcgcctcagtatcctcaggggcgaggtattcccccattacgatgaaaccacgtttaatatggacgaggatatcaatctgtctttggatgatccttttttcgatattgatttcaaccgtgatgagaatcgtgttgccgaaggcatcgcacagcgcaacggacagttgtggattatgaaaaaagcgaagcaggaatacggtgtggacaaactcatcttttccgtttggtctgctccggcttatatgaaaagcaacggcagtacctcgcaaggttttttgaaacgcggcagctaccaggcctttgccgactatctttccaatttctgtgatgcctacacagcggcaggtctgcctgtctatgccatctctccggccaacgagcccgagtatgcggcaagctggaactcatgcctctggcttcccggtaccactacgctgggaccgttcattgtgaataacttaggtcccaagttgcgacagacccatcccgaaacccggattatctttggcgagaatgcccagtggtctgccattctgggctttatcatgggcagtaaaaattatgtgcgcgatattctgaacctgaatcctaaaatcaccaactttcccgtcattgccgccggacacggctatgtggatcctgtgactgggaaagatcctgccattgaaccgttcagcaaagccgaatcgaagggaattcccgtgtggctgaccgaaatcagcgatcctacggaaagttatgatgctaccatgaccagtggcttgaaatgggcgaagaagttccatcgtttcttgtgtgaggccaataccggcgctattgtgtggtgggcaggtgctataccggatggcggaaccaccgaggggctgattaacattgaaaagaaccgcgtggactatgaagtgaccaagcgttgcgaggtgttcggcaacttctcccgttacatccctgtaggaagcaagcgcatctcggcgcaatatgatttcgaacaaggctatatggtgtctggctataaatatggtgacaacggttacacggttgtagccatcaaccctgcggatcatgaagtagttatttcgttggctcttgaaagcgctcaggtttccggtgctttgcaaggctatgtcaccgatgacacccgtaaatgggagccggtggaagctgttcaacctgccgatggtgtctataccctgaccttgccggcccgtagcgtggtttcctataccggaactgtgttgagtagttcgtctttgtaacgttggttctgtttttatttctacgctgcaatagttttttgttccgtcattgtattgcgctgataaacagtaatatgcggtgacggaatttcctgtatccccacgaagtgctttttcgttttttccttgcagaagccggttcgtcggatatcggtttccatgtcgggtacgtaatcttgatatatgtatggcagtatccgtgcaaggggatgggagtttccatgcaagaagactgcatcatttgttgcaccactcggctgaacgtgccttttcactcaagtgaagtgccgttgccacctgtgtgaaacggttgcttcaccaaggtgaagcaataaagtcataagactgttttcacggttgcatcctgttgataaaatacatctattgaagttttgtcattttgtgtgtggcggttgttgtgttgtacattgatgaacgataccaccgcttacctaccggttgagagcctttatggatgtttttttacagtaattggttgataattagaagaatactgtgtaggaaaaattttatatttcacgttcaattcagatgcgttttccattgtcttgaagaatttttttttgatattgataagatttcattgtttaatgcttgaattgtatttgttcctgcttgcttgaattgccatctttgcaatgttaatttttaattcaaataactatgaaaacaaagacattcttaatttcagctgctattcttccatccatggggcattaccgttgtttgcgaaagcaataacgtgttggaaatctatttttagttaattttacagcaatattttttaattaaactctaatacattatttatgaaacaaattgcatttacatggttgctgtgcatacttagtatatgtgcctatgctcagcaaattactgttaccggaacagtgacggatgcggagaataatccgttgattggtgcggctgttgttgtagtaggaactacggatggcgtgattaccgattttgatggcaaatataccattaaggccgctttcggtcagtctttgaatttctcttatgtaggttatcgggagcaaactgttaaggttgatggccgcagtgtgattaatgtgaaattgtcggaaggtgaattgttggacgaggtggtggttatcggttacggtacagtgaagaaaagccatttgacaggtgcggtcgcttctgtttccggtaaagagttacaggcaaatgttgcacgtagtgcttcagctgctttgcaaggaagagttgccggtgttactgtgtcggctgccaacggtcagccgggggaaggcttgaatattaatgtccgtggtatcagttcattgagtgccaccagtccgctttatgtgattgatggtgtgtatggtgatatcaatatggttgatcccgctgacattcagtctattgaagtgttgaaagatgcttcggctgctgctatttatggttctcgtgctgctaatggtgttgtattggtcactactaaaggcggtcgtttggaaacttctgcccgtgtaacagtggatgcctatacaggcgttcagatggttgccaaatacattgatgtaatggatggtaatcagcttcgcgatttggcaaaggctaccggttatagttcggcagaagggttgctgaattggaatggaggtgctggaacagactggcagaaagaactttataactcggctatggtgagcaaggttagcttgaatgtatctggaggaaacaagacttcgacctataatctgtcgggaagctatcttaaccaggatggtattgtgaatactaccggttatgaggcatggaacattcgtgctaagaatactttttcttttttcaataatcatttgcgtatggggactacgttgatgatgaaattctataaaaagaagtacgaagatgtttcatatacctccgctctgacagctgtgcctatgtggaatgtatatggtgaagatggcacttggggtgtcgctccggaatggaccagaggagataatcctgtgggttggacagaagcctatgattaccaaagacatgggatagacattttattgaatggctatgccgaagtggatttgttcttgaaaggattgaaatataaattcaatgtaggtataaacaaatatacaagacgtaattatgcctatagttctccttattatttcagttctacttcacaaaagaatgaagcggaattgtcggaaagtacagactgggagaatgattggttgattgaaaatacaatcaattatgataatacgtttggcaatcatacgatttctgctttggtgggttattctgcccagcgtaacaatgcgcgtggttttggtgcaggacgtaagggtttcccggaaggtttctctgtgattgacgccggttcggtttcttcacaaaatacatcgggtagcgcatgggccaatacaatgatttctatgtttgggcgtgtgatgtattcgtatgccgatcgttatatgctgtctgcttctgttcgtcgggacggttcttccaaatttgcagatggaaaccgctggggcacattcccgtctgtatctttgggttggaatgtgatgaatgaagatttctttgaaaatatcaaggaaaccatgaatgaattgaaaattcgtgccagttatggtgtactgggtaatttgagcggcattggcaattatgctacccagtctgttgtttataaaggtatgaataacatgatgggcacagaactttgggaaggtgccattaccggtaaggaatggacttcacccatgaatgtgacttgggaaaagacgaagactttgaacttgggtttggattttgctttcttgaacaataagttcagtgtcagtgctgattattttattcagaaaacagaagatatgttgttgtctatgccgcagtctttgagttttggcttgagtgggaatcctacagtaaatgcaggtacagtagaaaacaaaggatttgaaatttcattgaatcaccgtaataatgtaggcgatttgtattatcatgtaggtgtcaatgccacctttatcaagaatgaactgacggaagtaaacggaagtcgtgatgaatggcagggattcaatcctcatgccaaaggaacgatcacttatgccaagaccggtcattccataggttatttcaatttgataaagacggatggtgtattccaaagccaacaagaaattgatgcgtatgtggataagaacggtaataagatccagcctaatgcacaaccgggtgacttgcgtttcgtggattataacggagatggtaagattgacaataatgaccgtcaggatgtaggctctgctttcccgaaagttaacttgggtgtaagtctgggtgctgaatggaaaggtttggatttgaatatgttctttgacggaaactttggcaacaagatttacaatgcccagtattatactacggtttataatgaatcaacaggaaaccaatatgcagaacgcatgaacagctggactgaaaacaatcattctgacattcctcgctgtttgtttggtactagcgatcctaatggtacaaactggggctatacggaccgttggttggaaaatggttcattcttgcgcttgaagactttggaattaggttatacgttgcccaaagtatgggtatctaaagccggtttgcagaatgtgcgtgtttatacggctatggaaaaccttttcactataaccgattataaaggatatactcctgacttgggtatggtagatgccgatggtgccggtacatcaggtggttcgggtgtaatgacccgtggttgtgatgacggtcgttatccgatggcacgtactatcacctttggtttacaagtaaatttctaattaggaataagtaatatttgcagaatatgaaaaagaattttataaaatacatagctgcattggctgtagctccaatgttgttgtcttcttgtagtgatgactttctgaatgagattgatcctaaccgtcagactccgaccactttttggacatccgaggataatgtgatgaaaggcttgtccgcagtttataatcctttccgccgtatgaccagtggatattatggtgggttggaaggcatcatgcatcttcagatgcgcggtgacgacctttaccccactcgtggagaagaaccttatatttgggaatatttgtcgtttgtcaacacaacgaatacaaaggatttgagctggggaaacatctatgaaggcattcagatggcaaacgaattcatatatcgtgcggctacggttgatatggacgaaaccaaacgtgagcaaatgataggtgaggcttatttcttacgtggattctggtacttccgtttgcgtactgattatcgtgatgcggttatccgtactctcccgcaggatgcagatccggaaactcatggactgtctagcggtgatgaagtgctggaacaggctatttcagactttaaggaagccaagtctcgtttgcctaagcttcgttcaagcgatgagaacggtcgtgtaactcaaggtgcggctattgctatgttgggtaaagcttatatctggaaaggggattatcaggccgctaaggatgagtttgaaattataatgaatggttatggttacgatttgactcaaaagtatgaggacaacttccgtgacgatacggaatttaatgctgaatctatttgggaaatcaattatgatgccaaaggtaattcgggtgacgcttggggcaatggcactagtgacgactcgtttatgggaaacaaccttgctcattattttggcccgacactgaaaggtgagaatattggcggtggttggtataagatgcagccttctccctatttgataaaagaattcatttccgaacagcgtccggaaggatctgattccaaatgggataagcgtttgtacactacgtgcttctttaaatattctgatttcggtgatgtgaagccggatgaaaaattctatggtggtaaagtggaatttgatgatatgtttaaatggacggtactgcccgaaggcgatggcaaatatggtattgccaagcaaggatatgctcctgcttatccggttatcgagggtgttcaagggcgtttcatgatgaagaagtttgcagcttggtgggttcccacaggatgtacgatgtattctaacgatgccggacgtatcaacaatttacgtattatgcgctttgcagaagttttgttgctccacgctgaggcttgtctggaaaccaatgatgaaagcggagcaatgaaagatattaaccggattcgtgtacgtgccgggctgccggagaaaaacttgagtggaaaagatgctataatgacagaactccagaaacagaaattgctggaatttgccggagagaatatacgttgggatgatatggttcgttggtacggaaatgatcctgctaagttgaaagctatcatgcacgaacgcaagaccgattctcaacattatgaattgctttacgaagaaaatgaaagtggtgaaaaggaattggtaggatataaaccgacagaccgcatttcggatacacaaggatttgaccattttgaagctaaattcttgtacttcccgatacctcaggcagaggtggacgctaatttgaatttggagcaaaagccggaatggagatgattgtattgaactgataattaaaaagtatgagaggtgtgtcaaaacgtggataacgccatcgtttagttcgcaggggcgaggtccgctcgcccgaaaacagtttgctttgtgtcttcgggcaggtaaacccttcccctacaactgacgatgggataggcccggtttagttttgacacactcccataaaaacaatgaagccaaatgaaaaggaaaggatattatttatgctctttgttggttatgatatttgtatttttgtcatgtcgtgatgaagaacaggattgtacccaagctatgcaggatatacaaaaccagttgaaggaaaatgatttattgaaatctgtttctcaggaaggtgaacaatgtgttttgttattcgagtccaataagataatttttccgcaagagttaatccaaagtgtagatgtggatgcggaaaactggaaaacgactttgacatttgccaatggaagcacttatgttatacctaccttaggtacttcgattgacaacttgatattgagttctacagtcaatccttccggttgcaatccattatcggccagtgtagttgtaaaattacctgtattgggacgcattaaactgattgtacacagcaaaccgggaaagcatacgcctgacgtggaatatacatttaaagatgtgggattaaaacagaatattccggtattgggactttatcccaattataataaccagatcactttaatttatacggatttgcaaggaaatgaacgtgctcggtccaatctaaagcttcagacgaaaacattggaaagcagaaggctgcctaaggaaatcagagtggtaaaggctcaatatgaccgaatggagctaggcatgaatttggtaaactcccccggacaggatgaaacagacacttctattccttatatgatagatgctgacggagaaatccgttggattcttgattgggagaagtcggatgaacatcgatatatcggaatcgggtgcggattgatccggatgcagaacggacattatatgaccggtgacggaaaccatcatcggatggtggaggtggatatgatgggaaatacaattcataattgggatatgctggaaaggggatacactatgcatcatgccatatctcaagataagcaaggcaatatattagcgactgtgagcaagacttccgctaaaatcgccaatgggaaagatgtacggataaatgattttattattatgatggatcccgaaaaaggggagattttgcaagaatgggatttggtgcacatgttggattcggctcgctatggaatgaccgattatgatctaacctcagacccttttgcacaaagtgccagtaattgggcgcataataatggtatagtagagtggggagatgattatctggctacagctcgttatcaaggaatctttaagtttaataaagctggaggtattgagtggattatatcgcctcatgggtattggagagataaatacttgaaattattattgaatcctcttcatgccgacgggactcctattactgatcctgaggtgatagccggaacgaagaattgtgatgattttgaatggccttggggatgtcatacagctgtcccattacctaatggacacattctttatttcaataatggttatgggcgtaacttcaaactggattttacagacaggaaaaatatttatacttgcggcatagaatatgaagtggatgaagtgaaccgtacggttcgccaagtttggcagtatggaaaagagcgtggtgccgcgtattttactccggcccgttccggggtgcaatatttggaacaaacgggtaacagattaatttgtccgggaatgagcaatgtgcttagcaatggcaatcgtggtgcacgcgtgacagaagtagatcctgaaacacaggatgttgtgtttgaattggaattggaagatgcgatttaccagcgggtttaccgtatgtctctttatcctgagaaccaataacaacactgtatagaatatgattgatttttgataaaatagtataattctagatgcttggatagcattcttttactgtaaaagatggattgataacaatgaaaagaaaataagatatgaacggatatttcaaaaaacaaatagaagcattgcgccaacgccatgaagcgttgttgcaacgtcctaatgaaatgcaggaagaaacgaacggtgtcatccgccgttatgtttatccggtactgacacgccagcatattcccctggaatggcgttatgacttcaaccctgccaccaacccttgttgtatggagcgtatcggctttaatgctaccatgaacagtggtgccctgaaatggaacggaaagtatctgatggtggtgcgtgtggagggagcagaccggaagtcgttctttgccatagccgaaagccctaacggggtggacaatttccacttttggaaacgtccgctggtattgcccgatgtggatccggcggaaaccaatgtgtatgatatgcgtcttaccgctcaccaggatggatggatttatggtatcttttgcagcgaacgccatgatgacaaggcaccggcgggagatctgtcggcggcggtggcaaaggcgggaatcgtacgcacgcgcaatctggtggactgggaacggttgcccgacttgaaagcggcgagccaacagcgcaatgtggtgttgcatcccgaatttgtgaatgggaaatatgccctctacacccgtccgcaggatgattttattaatgccggaaatgggggaggaataggatgggcgttgatagacgacatcacccgggcggaggtgaaggacgaaatgataataaaccaccgttattatcacacgatcaaagaggtgaagaacggagagggaccgcaccccatccgcacctcccaagggtggctgcacctggcgcacggagtacgcggatgtgccgccggactgcgctatgtgctctatctgtatatgaccgcagccgatgaaccgtggcgcgtcatagctgaaccagccggctatctgctggctccgctggcgggggaaagggtgggcgatgtgtccaatgtgcttttctcgaacggatggatagccgatgacgacggtacggtatacatctattatgcctccagcgacacgcggatgcacgtggcggtttctacggtggatcgcttggtggactactgtctgcacacgcctgccgacggattgcgttccgcagcttcagtggcggcggtgaacgcgttgatagatcgcaacgaggcatttctgaacgggtaaaatagaaggaatataaaggcattgataagataaagtcgtttttaatgcggaatggctgttttttaggtggaaagagaagtggataatgccatttattttcttgtcgaaagggaataaatggctaattttgtaattataaacccaaaatagatattgtatgaaaaagattgctttatgggctatgtgcatagccgtaatggtgttgtcgggttgccggaaggctccggaatggaaagcggaacatgtgtttgtcatcggtttggacggatggggcgcctacagtgtggcaaaggcggatatgccgaacgtgaaggcgttgatggatgccggatgctacacgttgaaaaaacgcagtgtacttccttcatccagtgctgtaaattgggcttccatgtttatgggggcaggtcctgaactgcacgggtacacggagtggggatcaagaacgcccgaactaccttcgcgtgtgctgaacgagcatggcattttccccaccgtgttcagcgagttgcgcaaggcggctcccgatgccgagatgggcgtactgtatgaatgggatggtatcaagtatctggtagatacgctggctttgaaccatcatgcgcaggcacccgactataacacgcatcctacggctttgtgtgacatggcctgtgagtatattatgcagaagaaaccggtgttgagtgctttctgtttcgacaaccctgaccacgtagggcacggtgacggacacgatactccggcttattatgccaaactgaaagaactggacggctatgtgggccgtattgtggatgccatcaaggaagcgggtatttatgaaaacagcatcattattgtcaccgctgatcatgggggaatcaataagggacatggcggaaagaccatggaggagatggaaacgccgttcattatcgccggaaagaacatcaagaaggggggagctctcgaagagagcatgatgcagtttgactgtgcgtctactatagcatctgttttcaatctggagcaaccgcaggtgtggataggacgccccatgacacaggtgtttgaataaaagatgaagcggatactatgaaattgcatatcgttgatattctgattatttgtgcttatctgatggttattgtcgccatcgggttgtttttgaaaaagaaggcggcaaagaatatggattcttattttttgggcggaaagtcgttgccgttttatatgttggggctgtcgaatgcatcgggcatgtttgatattaccggcaccatgctgatggtgtattgggcttttgcttatgggttcaaaagtctgtggattccatggttgtggcccgtgttcaatcaaattttcctgatggtctatctgtcggtgtggctccgccggagcaatgtgctgacgggcgccgaatggataaagacccgtttcgggcaggggcggggggctacgctctcgcatactattgtcattgtctttgctctgctcagcgtgctgggcttcttgagctacgggtttatcggaatcggcaagttcatggagatcttttttccgtgggaggtagtgtcgcagtatgtgccctgggatattccggtacaatatgtgcctcatttttacggcattttctttacggccattgctaccttctatgtgatgctgggcggtatgctcagcattgtgtggacggatgtggtgcagttcctcatcatgacggtggcgggtgtggtcattgccattatcgggatgaacatggtggctcctgaaatgatccgggaatttgtgcctgcagggtgggagtcgcctttcttcggctggacgctggacattgactggagtgaacggatgagtttgctgacggaacgcatggcggacgagccttacagcctgatgggtgtctttgtgatgatggcgttgctgaaagggatttttatgagcatggcggggcctcctccgaactatgacatgcagaagatcctgtcgtgcaagtcacccaaggaggcggcgctgatgagcggttcggtatcggtcattctgctgattccgcgttatctgatgattatggggtttgcgttgctggctatctatttctttaaagtggatggaggactggaacagatgacggctgtccacacggatttcgaaacaattcttcctcacctgattacgaagtatgtgccggtggggctggcgggtttgttactggcaggattgctgtcggcattcatgtctacattcgcttctacggtgaatgcggcaccggcctatgtggtgaatgatatttatctgaagtatatcaacccaagggcttccgtcaggacacagatacgggcgagttacctcgtttcggtactggtggtggttatcagtacggtgatgggcttttttctgaaggacatcaacgagattttccagtggattgtgggcgcgttgttcggcggatatattgccgccaatgtgttgaaatggcactggtggcggtttaatggtgaagggtatttctggggaatgacttcgggtgtggtggctgccattgtgatgaagttcacggtacccgattcgttggtactttattttttccccgtgttgttcggcatttcgctggtgggttgtatcgtgggtacgtactcggcacctcctactgacgaggagacgctggtgaacttctatatccgggtacgtccgtgggggtggtggaaaccggtggcggccaaggcggtagcacgctatccgcaggtgacgcgcaaccgccatttcaagcgggatatgttcaatgtggcgattggtatcgtgtggcagtgctgtctcactattgtgcccatgtatctggtggtgcgcggtacggggggactcattgcgtcggtgttgctgctggtggtgaccaccgtggtgttgaaatatacctggtacaggccgttgtgcagggaagagaaggaatatgatgagttgatgaaacgtatcggaatggactgatagacaaaaaagggtaaatgtgtcaaaactaaaatggctacctcgcaaagttacagatcgtatttataacacttaaaaaagggtcgtatcaagctctgtattgagtaatgatatggccctttctttagccttttaggatgttcaaatgccagattataagttcgtattttcaaaaacagagttttgacatcctctttttgtctgtcaatatcaaccggaaggtttagctcacttcgggcggctccagtatgcggctggcgtactcatgttgtagcggtagctcgacaccttgtttcatcagtattcttccggagaacattttgttgtccagtggcagcggacgggcatcttttccggtttagttccgtgatgcggtattgcttgtcggctttcagcctgtccatgcggaaacggggaacaatctgattgcaataatgctgaatcttgtaggcaagaacacggcatgttttttctgtggggtgtagagcatcagtgaggaaacacctttatcattgtaaggtgagatgagacggtatgataaattgtccagctgtatcatcggacggattttcttgtaggtaataatggcttcacgttttcgggaacgggcaacggcagggaggtgttcggagtagctatcagaatatcttgttcctatacccggagcggaaaggaagagaagaggcataagtttgccggaagtagttttttcatgggatggtatttttttgaagaataatgatctgtatgtttggagttatgcaaaaatgaaagaagtttttggcattttatgatagaatattattcatgtggcactatgtgcgcattttatgtaattatgaggtgctttgccgcaataaatatcaaggaatctttttatctttgcgaatattggtaatcagtgcttaagtataaaaaaaggttatggaaaagagagataaagaggaaatgagccgcaggaagtttctgaagatagtaggcgtcagtgcggctgcatcggcggcagccctgtatggttgtgcatccgaagggaaaccggcttcatccgaggcttctgtgttgggcgaagtgcctgtggataaaatgacgtatcgcgtttcccccaaaggggagcgtgtctcacttttaggatatggatgtatgcgctggccgttgaaacctgcaccggacagcgatggaaatgtgatagatcaggatgcggtgaatgaactggtggattatgctatcgctcacggagtgaattatttcgatacatctcctgtttattgccaagggttttctgaaagagccaccggtgcggccttgaaacgttatccccgcgaaaagctcttgattgcgacaaagatgtccaatttccaaaactatactcgtgagaattccatcaagatgtaccatcagtcgatgaaagaattgcagacggattatctggattattatttgcttcattccgtaggtggaggggaagggatcaagactttccatgaccgttatattgacaatggagttcttgactttttactaaaagagcgtgaagaaggccgtattcgtaatttgggatggtcatttcacggatcggtggaagtgtttgattatttgctgtcgctggatgtgaaatgggattttgtgcaaattcagatgaactatgtagattggcgccatgcttcgggtagaaatgttaacgcggaatatttgtatggagagttggccaagcgtggaattccggctgtgattatggagccgctgttgggaggacgtttgtctaaactgaacgaccacctggtggcgcgcttgaagcagcgtcgcccggagaacagtgtggcatcgtgggcgttccgttttgccggtacgtatcccaacgtgttgtgtgtgttgagtggaatgacttatatggaacatttgcaggataaccttcggacttattcgcccttggaacctttgaatgaggaagaaaaagagttcttggaagaaacagcccaattgatgctgaagttccctacgattccttgcaatgactgcaaatattgtatgccctgtccttacgggttggatattccggcaattctggtgcattataataaatgtgtcaacgaaggaaatgtgcctaaaagcagtcaggatgagaattaccgccgtgcacggcgtgctttcctgataggttatgatcgtagtgtgcccaaactgcggcaggcaagccattgtaccggatgtaaccagtgtaatccgcattgccctcaaagcattgatattcccaaagaactgcatcgtatagacgcatatgtggaacagttgaaacaagagactttataatggaatggataaacatgataaaataaggaatgcttatgttacgtaaaataagacttgccgccgcccttttgttctttacaatgatcacgttgctgtttttggattttacaggaactgtgcatggttggtttggctggatggcgaaaatacagttccttcctgccgtgctggcattgaatgtgggggtggtgatagcccttgttttgttgactctgcttttggggcgtgtctattgttcggttatctgtccgttaggggtgtttcaagatatcatttcctgggtttcgggaaaggtaaagaagaatcgtttccgctactcgcctgctttgtcgtggttacgctatggggtattggcagtgtttgtcgtcgctttggtagcaggggtggtttcattggcggcgttgattgctccttacagtgcatacggccgtatcatttctaacctgctgacacctttgtatcaatgggggaacaatgtacttgccctatgggcggagcgtgtggacagttatgctttttattcggtagatgtttggatgaaaggtctttctacttttgcagttgcagtgggtactgtgattgtgctttttattttggcatggcgtggaggaagaacttattgcaataccatttgcccggtgggtacagtattgggattcttatctagatattcttattttaaaccggttattgatacgtctaaatgtaatggttgcggactttgtgctcgtaattgcaagtcttcctgcattaatcccaaagcacatgagattgattattcccgttgtgttgcttgtatggattgtctaggcaagtgccgccaaggggcaataaaatatgtatcggggcagatgcttctgaagaaacaggctccggcaagtgaaggaattggcaaacaggtttctcaggcgtctttaaacaaagaaaaggtagatactgcacggcgtgggttctttacggtttcggctttgattgctgcaagtgttgccgtaaaagctcaggaaaagaaagtggatggcggtctggctcctcttatagataagaaagttcccaagcgtgccactcctattgttcctgcgggagcattgagtttccgtcattttgcgcagcactgtacggcttgtcagctttgtgtgtcggtgtgccctaatcaggtattgcgtccgtccggtgatttgaaacatctgatgcagcccgagatgtcttacgaacgtggatattgtcgtcctgagtgtgcgaaatgtgcagaagtatgtcctactgatgctattcacttggctgatctgacagagaagtcatctgtacagattggtcatgctgtgtgggttgctcagaattgtatagtgaacacagatggggtaagttgtggaaattgtgcccgtcattgtcctacgggggctatcttgatggttcctaaagatgccgatgatgaaaaatcacttaagataccggttgtgaatacagaacgttgcatcggttgtggcgcttgtgaaaatctttgtccgagccgcccgtttagtgctatttatgtagaaggtcatgagatgcatcgtattatctgaatgaaatagaaaggaagatggatgaattaatcagattgttgcatgaaggcggctattcctgtgttatcagaaaggaagagatccgtacttttacccaacgcggggtagccgatttatatgatttgctgaatcagcatccggtctttttgcatggagcgcaggttgctgacaaggtggtaggaaaagcagctgccgcattgatggtgctggggggtgtccgggaggtttatacggatatcatcagtgagcctgcattggctgtattgcacaaggcgaatattagggtggagtgtgttcaaatagtttctcgtatttggaacagaaaccggacaggttggtgtcctttggaaactctttgctatgagttggaatcgcctgaggctatgtatccggtgattcagaattttgtggaaaggatgaggggcttcggaagctaactttgtggttcttgtcttgtttcaaatgtgctgatgatgctgtacgttcggagagtaaacgttttgcatataatcttaactaatgttgtctgtcagatggttttcttcgaaacttaatgaaattttgctaggaattcttaaatcttcattatctttgaagcataaaacaataagattatgagtgaccagataaaacaaatagctgagcgtctccagggattaagggacgttctggaactgactcctgatgaagtggctaaaagttgccagctttcagtggaagagtatttgggtatggaaagcggggagaaagatatttctgtcagtgctttacagaaaatagcccgtaaatacggtattgcattggatgtattaatgtttggtgaagaacctaagatgagttcttattttctgacccgttgtggttcaggagtgtcggtagaacggaccaaggcgtataaatatcagtcattggcttccggttttcgcgggcgtaaggctgatccttttattgtgactgtagaaccgaaaccggaaaatactccgattcattttaactcacatgagggacaagaattcaatttggttattgaaggaagaatgttacttaatataaatggaaaagaattgatcttgaatccaggtgacagtctttattttgattcttctattccacatggtatgatggcattggatgataagactgtgaaattcttggcagtaatattataataaattgagattaaaaagactgcgttgtcattgaccgcaactatttctaatttttggttctcaatttttaattgaataagattatggtagaaaaattcttagaacagaccacatttacctcacaagaggactttataaagaatttaaagattaaaatccctgaaaattttaattttggttatgatatagtagatgcctgggctgccgaagaacccgataagaaagcattgttatggactaatgataaaggggagcatatacaatatacttatgcagacttgaaaaagtatacggatatgactgcttcttattttcagagccttggtattggtcatggtgatatggtgatgcttattttaaagcgtcgttatgagttctggtactctattattgccttgcataagttaggagctgtggttattcctgcaactcatctgttgacaaaaaaggatatcgtgtatcgttgtaatgctgctgatatcaagatgattgtagctgcaggagaagatgtgataacaaagcatattatagatgccatgcccgattgtccttcagtaaaaaaactggtcagtgtaggaccggatattccggagggttttgaagattttcataaaggtattgaaaaagctgctccttttgtcaaaccggaacatcccaatacgaatgaagatacttcattaatgtatttcacttcgggcactacaggcgaacctaagatggtggcacatgattttacatatcctttgggacatattgtaactgccagtttctggcataatttgcatcgtgacagtcttcatcttaccattgccgatacaggttgggggaaagctgtttggggaaaactttatggacagatgatagcaggagccaatatttttgtgtatgatcatgagaaatttacaccggcagatattcttggaaagattcaggattatcatatcacttctttatgtgctcctcccactatttatcgttttttaattaaggaggacattagtaaatatgatctttcttctttggaatactgtactacggcgggagaggctttgaactattctgtatatgaaacgttcaagaaaatcacaggtattcgtctgatggaaggttttggacaaacggaaaccacgttgactttaggtacttttccctggatggagcctaaacctggaagtatgggggtacctaatcctcaatatgatatagatttgttgactcacgacgggcgttctgctgaagatggagaacaaggtcagattgttattcgtacagataggggtaaaccattgggattgttcaaagaatattatcgtgcttcggaattaacggaagatgcttggcatgatggtatttattatacaggtgatgtggcttggcgtgatgaggatggttatttttggtttgtaggtcgtgctgatgatgtgatcaagagttcgggttatcgtataggcccgttcgaggtggaaagtgctttgatgactcatccggctgttgtggaatgtgcgattaccggtgtgcctgatgaaatccgtggtcaggtggtaaaggcgacgattgtcctttctaaaacttttaagggtaaggaaggacctgagttggtaaaggagttacaagatcatgtgaagcgtgtgactgctccgtacaagtacccacgtgtcatagagtttgtagaagaacttccaaagaccatcagtggaaagattcgtcgcgtggaaatccgtgaaaaggataaataatcagttgtggactgatcggagttttattggtaaaataattaaaaatgaaaaaggttttacttcttgtgtttttaagtctggcttggctatcagtaagtgcgcaagctttggttcctattacatggacagcctatggtctgacttttgaggctccaaaagggattttggtggaggaggatacagaggagacttttcttctgaacaattccaagttttatatcaccattcagtctttggattcggatggtatgacaaaaagtgacttgaaaagtgtattaaaagactatgccaatgatgacggggtgaaagaccagtcggcagtgcaggagtttgagttaccacagtttttcggtacttatttaagagggagctgcgaaacagatcattgcctttatgcttgtttgatgactaagacggcaggtagtggattttatatatctattatctatagcaaggaaaatgaaaatattgccgaaaaaatactgaaaagttttataatggaggaataaacaaaagagcgttaatgcttgtttcttagataagagagcgttcaaaatttaccagaaaattactagattattaatagcaaatgaaagggctgtcttcgtgagaaggtagtccttcttttttgtgtagttatgaatgttaaaggactctatgatccatgtgtaatatgctttgccggcatcagaaaatcaaatgattttgggcataataagggacactcatagaatataagttagccaactaattcgcaatactttaagtatgaattagctggctaacttatattattctatgaatgtcctaggttaagacattaacgtccggtccaccataaaggagtgatgatattatctgagcctcctaacaactctacagcttgtttatagccttcgggatctgcattctccagactggaaggatatcgcatacgttgtggataaaattcccacttctgtccgtctttccaagaattaggattccaagcattaaccatgtctgaaccagtcattgaactttcgtttgcaggaatctcaaagaatggtaatcccaaacggcggaaatccgaccacatttccaataccaaatacggagtttgtgcaatgaatttttgagtgataattttagtcaagtggtcattcaatgcttttccatataaagttttagaagctgtaggatattcataagtaacagttttctgttctttgctgtatccatccacataagtcatttgttcagcagtcggttcagtggtatgatcaaatttgactgaagtacctacacgattatagttggtggaattcagataatcattcacatattcgctaacaccaaagtattcaaaactagctttaataccgttctcataggcttcttttgctgttgttccagtgttccaaccatacaatgaagcttctgctaacaagaaataagtttcccatgctgcaaagaatatgcgagatttgccctgacaatagtctttacccaacattggaagagtacagccggggccatatccatttgtcaccagttggttataagccaaggttggcgaccatccaccgcgcgaaccagcgggataaccattccaacaacgagttgcatcaatctttatttccccaggattatccttattaggaatcggattcccgttttcgtctactgtgtaaagaacgaaatctttagctgttctatcattatatttatctatgtagttctcagcattttcatcatcaggtaaacagaatatctttaatgcacgcggatcaagattttccggcataccatccagccaatattgtttagtaggattatctgtattagcaacataatgtctgtcatatttaatacctaaataattagctggtttaacataactagccaaatcggaacgttgttctgttactttaataccacctaaattggtcagaagattagcaactgttgaggaaagaacctgatcgtcaaatgaacgggtatatactccggaaaagacatcccatccatcattttcttttactgcaaacatctcatcagccgttaaaatcttgttacctttagccgcatcctcaaattcggtctgcgcagttgccttgtcgatgtttgataaacgcatagccagacgcatacggagtgaatttgcatatttctgccacttcacaggatcatattttacattgtcaaacgggtcgcatttaccttctgcctcaacaggtaggacagaggtgttgatagctgctgcggcttctttcaactcctttaaaatgaattcataatcatctttctctgagttgaaaacaggattttcccctaggaaactttcaataggataaggtccgaaattatcgacaaactcactgataagataggcacgccaaatacgggcaaactgctttacgttcgggaaaaattctttttcatgtgcagtggtagtggccgcttcgagttggttctctactgctgtaatagccaacgtcgcatttttaatactggcgctgagatcaggataataataagcagatgtataatcatcactatagcggcctacgttcagaaaactcatttctccacaaattctggcagcactagcccaattatagactactatacgttctgcagtaccgggattcatctgtgcctgtcctatagaattattcaatgcatattgaggttttacatattcctcaccggcagctgtgggattggtattgacttcatcaaagtcagagcaggaaactaatccggcgcaaaagccaagccccaaaaataatttattcattgttttcattgttctttttcttttttatgattagaaaccaagagtcacattaaacaggtaagaacgtgatgtcggagctgacgagttctccaaacctgttgcattagtgcttgtagcatatactgattccggatcaataccatccaaatggcttgaaatcatccatacattattcacagtgaaaccaagcttaacctgttggaacggggtctttttcaacatagatgacgggaaacggtaactcaaggcgatgttacgcaaacggatgttggtagcatcatagatataagcttccgaaataccggcgcggcctgtagccaaagctttgtaataacgttctaaagaaacactttgatcatttaccttataaccgttgccatctttgataactcccgctacaacgatatcctcacgtttaccgcctggagcagtacattcggcaataccactacgttgcaagttcatattggtgaatgagaaaatatcgccaccaaaacgtccgtcaatcaggaaactaagtgtgaagtttttataattaaatgtatttgtccatcctaataggaagtcaggctgttgttcaccaatcttatgcttgtcactagtggcctgtggcagtcctgattcattgagtaataattgtcctttaaattctccttcttctactcgttgatatttggtaccccagatttcaccataagcacctcccgcaactgcataaacctgtaatgcgtcagaacctcctaaagcatactgcatacctggttttcccggtaataattcaataatcttactcttgttctgagagaagttcaactgagtatcccaactaaattgagctgtttcgatagggcgtgcattcaacatgatttcaataccggtattttgaatgttacctgcatttactttcatgttatcataaccggaaaggttatttaaaggaatattcattaactggcgttttgcgtttgtcttgtaccatgcaaagtcaactcctaaacggttattgaagaatttcaattcagcaccggcttcccaagaagtaatcaactcgctgcgtacatctgcatcgtatttggtttttccttgtccggcagttgtattgccattagggtctgaaccaatactatatgtattatataactgatatgcatccatatcgttacctacttgtgcaaaagatgcacgtgctttagcataagtaaaccattcgggcatgcctttgcctactttacccaccatatcactgatcacccatgacaatgaaacagacggatagaagaatgaacggttttctttattcaaagctgatgaccagtcattacggaaagttgcatccaagaatgcccaaccattatagttgatcccaagagttccatacaaagaattgatttttttatgaatataggtttcggttattgacaaatcttttttgtcaccattggctaaagagaataaatcgggcgcagtcaattttcccatagaattatccaaacctgtagattttctttccattaagttaccaccaaaagagaaattaccaccaaattttccaaacaattcatctttatggccactgatcaaaaagctgaaattattttcgaagaactttttctcactagtgctgtaacggctgttcttattattagtaggacttcctgcatacaatttctcttcaccctcagtgaaatacatatcactaccggctttgatttcagcatccagccaatctgtaaatttgtacttcaatgatccgttcatcaggaaacgattgcgactgtctttattgggattataatctttagaccaataagggttgataccccctttactccaccagatcatttcgccgaattcgtctttgacagggctggaaaagtcacggatgtcaatagtcgtaggcatattgaaaatagtataaaatgcattattcccacgtgcaccactgatagggcggttttctgcgagggtattgatgtattgtacttttgcatcaatgctccaacgatcatctttaccaaaagtagaagatgcacgcaaagttaagtttgtacggcttaagttagcacccggtatcatgctggagtcatccatacgattcaatgaggtgtaaatggatgttttatcatactgctgctggaatgatatgctttctgataagttcacacctgtatcaaagaaattttttacgttatcaaagatttgcatatttgcagttgtaccatcccattttgtatagctttgccctgttacttcaggaccccagctatagccgttagttgagtcgaacacgccattctcaccttgtccaaaggctttttggcgtttagggagcataaatgttgtctcagcggaaactgaaccagagatagtgatacccaaaccttcacgctttgttccttttttagttgtaatcaaaataacaccattaccggcacgagaaccataaagtgcagcagctgacgcacctttcaacacagacatggactcaatatcttcagcattaatatctgaaagtccattacccatatccaatgtcgggttatcaatatcattattacttgctcctgtaaagttatccattggcacaccatcgacaacaattaacggctggttcaaacctgttacagaattcgcaccacgaagctggattttggaagaaccgccaggaccattacttgaacggataatctggacacctgaaactttacctgtcaaagcatttgcgaggttcgtttcacgagcttcaagtaacgcgtcaccttttacctcctgcatggcataacccagtgcttttttctcacgtttgataccaagagcagtcactacaacttcacccaatgtttgtgtgtcatcctgtaaagttacattcatgggttgtccatcccaaggaatctctactgtttgataacctacaaatgaaatttgaatgatatccccttttttcacattggataaagagaagtcgccatcaagtccggttatcgtaccattagtcgtacctttcactactacagacgcaccgataacggtttcacctgtagcgtctactacaactcctgtacaagctccattttgttgtgtgattttcacatcggcaacgccgggattggcgaccgcgtatgctgctccggtagaggcacccattaggaacagcaacatactgactgattttagtcgttttaacatagctgtgattttttttaaagtttattgaaaatcaagtaattccgtttccttagttccttcagaactactcttgcagctattgtattgatattcaatgaagttgaatatgataacgacaaaaagaaatttccatttaaagccgttaaaacaaactttaaatggaaattttctacttcatttctacccaaatcactactttgcacaaagaaataagggagtattacattccgtaaaagaatgagaactttcaataattgatgggaaagtttttcatcttacaaataaaaacagcatcggctcattgttttagaaagtccttatctttttcaagaagaatcaactctttacttacatataaataatatttgcaaaataattctatgtatagtcctgaaggtcaaaataaaacaatccccttgtttttacaggaaaaacaaggggaactgttattctttaattttattttcagttcttcggtcctttgccaaaatcaggattttctttatccatccatacacgttcgtcatgcaaaacttgtggattttttgcatttgtaccttgatatgtataaccttgtgctttatatgcagcgatagttatgtcatgtaactgatctgattccaaaggctccataacagcaaatcttctagggataggataagagtcacccaattgttcgtcaaattccttacgcggtaaaatggaactattcttcataggaacaccagaacgcataatgttaacatattgatcaatcggtgcattaaaataatggagatattcttggatatacactttttccaaatcagaagctttatctccacttaaattataagcctctttcttaagcagttctgtcagccattcctcttgcagcttaatggaaacatcatgagggtcatttacataaggactgtcataataaggtatatgattctgaccggcaacataatcatatccttttactgaagcagtgataccgtctgtaaaatactcttgggcacttttttgtccattccaagtagctcccaacagggtgaattcagccaagaagaaattggtttccgctgccgaaaaatacagaccataccagccatattgttgagtgtcctgaaccggagtaacatccggagcatccggataagtatatgtcaacaaaccttttaccatttcttgattccggtaagtacacggataatagcttttcttggcaccagctgccgagtacaaaacaaacaattgtcctgtggggtcaaaataatcctcgtatttgtccatctgtcctgcacctatttctacaggaagaccataataacgtacccaaggttcacctggaccaccccattctttaaagactttctttccatttttaacctcagaaattacattcttttctacaaaatccggcatttctcttttttgatcaaaataagcctgcacaacattagaattgtagtcattcttttggaagaaataaagcaaacgcggatctttgttgtttaccaaaaagtctataagatgttgcgtacctactcctacagaaaaatcattattccaattgttatcgaacttacccttgttatatacaaagtcatcatccgtagtagcaattaagccaacaggactttctgctacctgttttactatttcaaaagcacggttccggtctttgtttatcaaacgggctgcaattttcaatttcaaagaattggccagtttgccccattttttcaaatcacctttataaataaagtcctgattattcaaaacatctttgatttcgttactgctcagataattaatagtctggtccagttctttcagccatacttccaaaagttcctcttgagtgtcatacttaggcaataacaaaggaggattggtatatctggcttgttctgcttctgtatattgacgtgagccatataggtcggcatcttggatacttaaataaaccaacaaaggattacaaagatattggatatattcataagtcgctttttcctcttcaggcaactggctgatttgatatcgaatctcattagcataacgaagaacttcgtttacttcataaccacaaccattggcttcatcagtcggacgatttgaacgagttgtattacctcctgatgaaactgttgtttgcgaccaggtagaaagatcattaaatcctccaaaccactgtgcataatctcccggttggaaagaagcctcacatttagtgaacaggaaacgaatatcaggctttgtaatagtagacggatctgaatttaattcagagaattcatctacacaggaagtaaacattacacttcctaaaagcagtgcggctgctaaagttctatatttcattgttgataattcttttaaagttaacaattagaaattggcattaattgtaaatatgtaacttgccgtataaggctcgaaaccacgaatacggaactctgaagctgaattagaacgtacagattccggattcaggttattaggtaatgaattatacagatatcccaaattacgtgcactgaatgacaggttcaatccttttgcacccagtttgtgactgatgctattaggcaaacgataatttatagtaatattacgcaaagcgatataactcaacttgtgtacccaaatgtcatcaattgtctgtgctccccatgcataattatttccataccatgaaccggcatgagtgggttccagttttccttcctgtaccagctgtgcgtaagacagtccgctgacatccatttttgttccatccaccaaggtcgcaattgttccttctttaaaaacaccttccggaatcataccatcagtatattgaatacctttggaatcggcgtattgactagtccaagtcatacctccatgttccgggtcacggtattgcaaagaactttctgtccaaccggcctgagttccgtataagttacagtaagatgctaccaaacctccaaaacgcatatccagtccgacattcaaacttaaatctttccaagttaacgttgttgctacagatcccagaaaatcgggtgtcatgttgcccactacttccgctgttttgctttgtgctctatatgcgcctctccagctgtcatcccactccaacaaaggtacaccgttttcattacgtgcctgagtgacatctgacatcaacacaccataagactcaccgacttttgctacagagccgatatgatagtcgtatgcgtttacataaccggacaattcaatatagttggcaacattaggatgtaaggatacaattttacttctgtttcgtgtataagtgaagtccagatcccactgccagtctttagttttgataggagtagtatttaatgcgatttcaatacctgagttttggatattaccagcatttaccaactgttgggtaacaccggaaatagcaggaacattgattttcataatctggtctgtggtattttccttataataagtgaaatccaaattcaaacgattattaaaagtacggaaatccaaacctatttcccatgaattcttacgttccggtttaaggtcggcaatcttcatcagtttgtccagttcattggtatagatattgccgtcatacatttccattgtggcaaaagaatacgtctgattgacagcgtatgggtctgtatcattacctacttgtgcccatgatgcacgaagttttgccaagttaatccatgaaggcatactttcgcggaaagtttcattaatcaaccatgaacctgatacagaaggatagaagtatgagtgattacctgtacgattggcatataccaatgcagaagaccagtcattacgtcctgtaacatccaaatagaattgattcttccatcctaaatttaaagcaaaaatggcagaaataattcttttgctgcccgatatggtcgattcgctctttttagtcttttttgagttctccacgaaccattctccaggcaccaccattcctccgtcagttgatacttttgaatgttgggaagaggtgttgtaatactcaaatcgtgcgaatccaccgagtgaaaaatcttttatctgcttgctggcagtaaaagttccccctacggtaaattgttcttttatatcttgcgtaataccataatatcctccttcgtttgcataaccggaacctaattgcttatcttctatagaagtataataacggttcatattagcgtctgctttaaacttcagccaatctgtcatctttacatttacttcaaatgtaggacgaataacagtttccttccgtacataatcgtaattatctactttgaagaaataatttttagcgctggaaggaaccgaaccatattggtcaccatagctggtactggcaataccaccatgctcacctaaatatttgttccggaaataatctacgtcaaatagcgggttaatcacattggtatttgcattgacaaacaattcacccgcattcagttgtgcattacgcggttttgagttggcaaagctaaaagaagcagcaacatccacccaatcgttcaacttatggctagctttcaacaacatggagtaacgttcaaaagtattgttttctgttgttgatttggcatttttataagataaagatgtataaaatgatgttttttcattaccaccgcgaatagaaacattcgtgtttgtattgaatcctaatttatataaatccagcatattatttttacgtggagaataggtagtccatgtaccatcataattgcggatttgagagccatcatatctaggaccaaaaccaaagttgggtactcctactaacgtatgttctccattctgatttactgtaaactgatgttcatcccacatacttccattttggtcggcatcagattgtcccggcatgtatcctggaccatataaagtttgaatatccggagtcttgaaagcatggtcaataccaaatgtttgagaaacgctgatacccagcccttgtgtacccttaccggatttggtggtgattacaaccgcaccattcaaaccgcgggaaccatacaatgctgttgccgcagcacctttcaatactgatacagtttcaaaatcatcaggatttaagtttttcaactcattaccatagtcgctggcgttgttggcacctgcatcccagtctgctgtcgtattaccagatacaccgttatccagaatcactccatccaccacatagataggctggttgttggaacttaaggttgaagctccacgaatctgtatcttggtaccaccaaacaaaccaccatctgatcctgagatttcaacaccggctactttaccttgcaatgcggctaccggagaaatggtattggcagcttttaattcatctcccttcacttcagtaactgcatatcccaaagctttttcttcacgcttcaatcccaaagctgtaaccacaacttcacctaactgttgcgtatcatcttttaaagttacatcaataggctgtccggtccattttacttcctgtgtctgatatcctacaaaagaaataacaatgatatctcctttttttacatttgacaaagaaaaatcaccgtcaagtccggtaatagtaccattagtcgtaccttttactactacagatgcaccaatgacagtttcacccgtagcatccttgacaattcctgtacatgtaccactttgttgtgtgattttcacatcggtaacgccgggattggcgaccgcgtatgctgctccggtagaggcacccattaggaacatacttgtgctcaacaatagtaccgtcaaagtctactgctatggtcattgtatgtattacttcttgtaaattatataaattataattgctcaaattactctgtcttatttaaatttaggaagatatgtcattgatgttaattttagtaagattatgcgtcaacaatcatggagataacaagtgagcgtcatattccttgttgccggacatcagctgcttcattgtagttgagacatattcctccacgttaagtcctacattttgcaagtttcaaagagtgcccaaaaagtcaatgccgtttccacacttttctgttagtattaaattattgtataatatattatattaaataagtaaatatttcacaaaaaaacattatcaaatccaattggttttaactatcaacatacggctgcttgaatagaatcgaccgtttcaaataaagaaggagcggaaaaattggaaatgaaagccacaggcagttctgtcagataagttgtatatactcgggatcaacctccactcctacggcaagaaatccttccagttcgacgagcaggcgtttgaccttggagccccgtgtcgtgagcagccttccctcgtatccgctgagcggtccgccctcaatgcggatcttacgcccgtacatggttggggtaatttcttccggcaggtaatacctgggggattcagtggcatccacggcacggatgaaacgttccatgtccgtatcagccaccgtcatcggctcgcgccacgtgccacgcagccagcggtactggagggtaggtatcttttccacgacggcgtcaaggttgttttgtgtttcatgcacgaagagcaagtcctgtatgaagggcacttcctcacggatacgcattcccttgcgggtgaccaagtgccatttcataggaacgaagacctccatcttcatttcttccagcagcttataagcgggtactttggcgtttgcccttttcaagtcgcgcattacgtaccacctcattcctttttcgatccttgtaaatgccgccatttcgcttcaggacatatttatcaatcctgcaagattgtgaatatttctatcaatcaggcagttataaatacagttcgtaaaagttcgggatttctccctgttcttgttccattgcttcattcccgatcagaaatctgcgtctgtttgccattatatctggcggattttcaggtgcgtttgcacctgcttctgttgcacttctcttcgtaagagatgaacaatgcgacatatatgaataaaacagtctgataataaatactttgccttcttctaaaaagcagttcgctcaacaatccgttttgcggttttaaggatcggctcgtgtcccattgttatttttttactcattttgtggttattctcaatatttttcgtaattttgcatccggttattcatctcttacgaagagatcataatttttgcttaacattttatcatccctgaatattcttacatccaagattattccttgaacaagtattccttattcaggaaattcttttttcacttctctcgaaaagaaagcgtctgtccgctcgatatgtttgttattccctgcataaggaatttaaaatcaatctgttcgccttatcaatggtggcagtgtccaatgtagtcagatagatcctcgttgtgttttccgaatcatgtcccataccttcgctgattacggaaatcggaatattcttactccgggccgcactggcccaggaatgacgggcgacgtaatgggtcagggggacggacaagcccagttcttttccgatagctttcaaatatctgttgatacgatgggatgcgttgatatattgctttctctcgtccatgcccggtctggcgataatgggaagaaggtacggggagccgggaatattgtaacggtccacgatctcctgcatgcacggctcccattttacaaaaagttgttgaccgttttttttccgccggtatgagaggatgccgttgttgagatccttctttttcaggaacaccatatcgatcatggacatcccccttgtgtaaaaactgagaagcagcatgtcccttgcaaacctcttggccggatgaagtgacaggtccaatgtcatgagctgttttatcgcacgcaggggaacggcccgcttcgtcgttctctcgactcccgtatagacatgtctgaaggggaaacgctggataacgagttctttctccacggcacggttatataccgcccgcaggttgcgcatgtaaaaagagatggtgttcatggaaaccccgcctgatttcagccacgcctcgtatgcgatcatcaggtcggaatccatatcacagggcggtatgtctcttccctccatgaaacgcatgaaactgttaagggtagaggtgtaggtctcgcttgtccgtatcttgcccaggcgtttcagaccgttggtgacctcccgcataaatacggaaaaagacagcccgcaatgtccatcgtaaaaggcagaggttacatcatcagcggtgaaagtacctcccttccgttccagagctgtgatgacattctccagacggtcggtatcttccgctatttttttatccaatagcaatagatattgtcgtctgtcctcatcggatgacgcgatgacaatccgggaatgccgcttgctccattcggcaggaaacagcttgcaagaggtgttgatctgccttgccacacgtccgtgaatcacttgataataaaccgtaccctctctgccgtccacagaagaaggtctgaatttaatttttactgtagccataaactctctgatttaaaattatacagaatgcaaaattatcaaaaggtggtagcccgtcttttgctggcgagccatgcggttatgtaccatccggtaaaataccgttccttgtcagccatcggctgccgacgatcggaatttgactttcacccttgccatatcatctccgcctttttgaatttctgcccctgatcgagtcggccttgtttcccagctcccttgccgcacgctcctttaaccgtgcctgctcgataagggcggcccgctcgtgtaccgcttcctcgtaggcttccacatccttgcgcatttggtttatcttgccgttgtcacggttgaatccgaaaatattttccagtccggagatattttcaggcgatgcttcgcccttcatcctgatgtagcggtacttcaggtcgttgtcggcacggtcgtagtccggctgtctggccgcatggagggcgactgccaggacggtgaccatcgcgaacatcccggtgaaagtccaaagtatacctttggactcgatgctgacagtatggcggtgctcgttgcggatctttgcattgtcaccggctgtcttcagcagggccttgatctcctccgaggtctgctccccggtttttcttatcccggccaggatttcagcggtcctgtccggcaacgggttcctgccggacacgtcctgcatgcttttgctgacggcgaggagcgttccggcatattggctgaacgatttccggattccgttcaaatcccgttcaagcccgtccctgatttcccgtaacatggcaattccggtctcaccgcccgttaccgcgttatttttatctaccggggcggatgacaatatctccactttcttctcgatcctttcaaggcatccgtagatgccttccagatagttttcctgtttcatctttcaaagttttttcgttatacatactagtttacaaactccttcctttcctgcgcttcttctttctccgcaggcgttccgcctctttctcgtcctccgtcggtgccaccgacggcatgaacacgccgcccgtaccggtgacttcgaccaggttatcaataacaggaccatgactttgttcatggcatggttgcttttgggaaacgtcattttccagggacgtgacatggttatggtccaatgccgcatccagccttgaccagctgaaactgcggtcaatcccactccccttgaatgacagaccgtccttgataaagcggattccctgcacttcattagtgtttcccttgtacttgaattccatttccacgcccatttttaagagcctattttgaaattccttccatgtatctgcactcctcaaagcttccttgaccgcacggtatatctcgtatttcaccctttcggaagcgtgcagtttttccgttttaacggcctgtttgccttcggaataggtgagcgaatacttctccttgagcattttcgtcaccctctcgttgcgcctgaaatcgttgctgtcggaaatcaccttcccgtcgaagtccacccggttgaagacgatgtggcagtgcgggttgcccgtcccgtgatgcctcaccacgatgaactgcgtgttccgtatccccatcagctccaggtatgcctccgccagacttgccatgaacgcgtcggtcagcctcggtgcgtcctccggcttgaagctgagcgcgatgtgtcccaccggtttcgtcacgtccggattcagcaggcattgccaccggaaacttcgcgccatctcttctgccgttcccagcagcacaccttccgaaacgatgattttcgcgtcgtccttctgtgtcacatagcgtatacagccgccgaacgagcgtccttttttgatcttccctatcatgaggctatcctcctttaggcctgtaatcatccatgatccgcttcagccttcccagcagctcctctatcagcagccttgtcctgtaaaagcctgcctggtgcgagagctttgtcagccggttcaggttgttcgccattcccgccaggctgcgcagcagcgcgttctcttcaggcgtatgccttgccgtcacggtggccgccagtgccgcctccctgatatagaccgccagactccggccggacttccctgccctgaacctgagagcctcgtagctgacgggggagaacttcactgtcactcccctggtcagcttccgcgtcctgcccagtgccggacggccgcgttttttcttcatcccattcatatccgttgtcatatgttttttctttttcgtccgtacttctttcattccaaaatctgcgaccggcgggagcggatttgccctccctgcaaccgccgggcgcgggggagcaagggttttcgggaatccggaaacataaccttgctcccccccacagaaaaatccccccgcattttccacattgaagcgggtacacaggggactgtgcatacatcgggtatactccacgcccggtaacaggctgtcagatttttctccactgctcgatgtcctcacggtaggcggcaagatgctccctggcaaggttctccagcagtccggaaacgctcatgccacgcccaccgagcctgcggacgatggcgtccagttcgtccctcacatcctcactgacgaacaccgtcttgcgattcctaatcttcgggacggtgaggtatgtttcccggtactcctccagcgaggccctgcgctgcctgccgctcgtcctttttctcacggggtcttccggttccggcggggtgtcctttcttcccgcttccccggacacttcttccgcaacggccccggatggaatcaccggttccgcatccgtaccggcggattctcccgaaccgggttccatcatgagtctttcccaccactcgtcgtggccgggtccgggactacggccgttctttctgtctgcggtttcggataccgccgttttcttccctttcgttttttcagtcggttcacttttcattgtacatggattttagatggttgatactgtgggcacagtctacccgtttgcccgattgtcggaagcaaataaaacgataataacaagtgctgtgaaacggacgggtccgattggcggggtttgccgtgttattcatattgttggatcagtctgacggtgatgacttcacaaatatacgcaccggaaatttcccactcttcgggaacggatctgaacgtctgtttactaaaagcaaatgaatgttaaaatccgattcccatgacatctgatgacatataatgacatctgatgaaggggcggaaccatatccgggaacaatcatttactttgcggatgaaacaagtacgcatatggtgtcaaaggtagtcatcctgtcttgaaattcaggacgttccgccgggattcactaaattgcggaacggaatccggatccgaaaagagaatgaaacagatgtcaaacctgaaattacagtgattatggaaatagtgaacattgaggcaaggaccttcgaggcgatgctctcggccttccggacgtttgcggaccggctggacaccctctgccggctgtacggcgacatggaggagaagaaatggctggacaaccaggaggtgtgcctgctgctgaaggtcagcccgagaaccctgcagaccctccgtgacaacggcacgctggcatacacacagatctgccacaagacatattacaagcccggggacgtggaaagcatcatccggatagtggaggagcgccgcaagcgggctgaaagtatgggaaggtcgatctgaaaggtcatgaaaaacgaatgtcgaacaaaaaaagatcaagtcatgatgaataccgataaccgtctgctcacccgtgagagcagcgagcatataagagagttcttctccaccgtcgagcgtctctccgtttccatggagcgtctctttgccggcaggtcaccggcgatggcgggcgagaacttctatacggaccgcgaactggctgaaaagctgaaagtgagccgacgcagcctgcaacagtaccgtgacagcggtctgcttgccttcacccggctgggcggcaagatactgtaccgttcctccgacatcgagaagctgcttgacagttgctaccaggaggcgagaaccaggccggatgaacgactttgatttgctcataaagtatttatacacagagcgtttttctttacgaattatgatccggtgacaacattggcataacatggcgggacatggaaacatttttccggtatggcaataagatacggggattccattataaaaaaagactcttattttattatgtcattatgttattctgaaattggggcgggctgtccgtgtaccggtggaacggtccgttcccgtaatggcggcatatcccgtaccggtatcattatcctccggcaatgccgcttcccggtcttgtcggagtgaccttatgccggccggtgacaaccgcatgtccgtgcgtaaacatggcggcgcataaaaacaggcacatcccccgggctcctgtcccgtcggatgctcctgtctccgtcatgtcatatacagccggactcctccggtccatgcctctatctcagtatcgggttcgagagcagtatcttgtaataggccaccccgccaatctctaccggcatcctcgccatcatgaactgcacgctcttcctctccaccttcgcctgccgcatgagcctctgcacgataaaccccgccgagaaccttgcgcatcttttgtccttccagacgatgaacccctcgctgtcgtcggcccggcagatataccagtcacccgtctcgtcgtcgtgggcgaagttcacccgtccgccgccgaggattcctaattcgattgacatcgtctttgacagatagacagtccccctgctgtcaaggttgatggtccgcttacccttgtatgtgacttcctgcggacgggagttttccctgttgtatactatcagtgccataattgtctttcttttatcggttgaactgttttcgtttttttcaatacatgaagctttccaccgccagcatttggcttctccatgcgaaaccgctgtgggtacgtaccgcgtccactatcctgcatactttctgcgatatggccgatgccgatacgcccatgcattccgccagtgccttgaacgagaattgcgcctcatagaaccggagcatgaacatccggtactcctcgtaggagaacttctgccttacgaaacgcagtatgtccttaaccagcctctcgcacccgttcaggtcgtcctcggaaaggaattttgcctcctcgccacatcggagaaagaaatcatcttcagggtgtgcataccggttctcccttttaatctttaccagggccgcctttttgtagcatccgatgaaatacgcgtcatagtccgttatgtcctttccgggaaccagcacctgccttcttacgaaaaggtaggtgtcatggaaattgtcctcgtccagcattccgtaccggcgtaacgtccctctcaacctgtcataggattttgtgaaccactcgttgaacagtctttccttttctgcgctcttgtctgccatagccttatattttttgagttatacatggcctacacgggtaggcattcttatttcttgtgcttcctccagtttgtttttcggcggtctccggcaaggcttgccgtgaaaaaatacgctcacgcaaagcgtgaggaagattttttcacgagcaaccagcccgcagggccgccttgcgggaccggcctgaaaaacaactatttttgccgcaagaaatgaggatgacggattacttccttctatctattgtctgtcctatgagaatttaaaattccatgcagcttttctgtcttcggtatgtttggagaaatattcaaggatgtggaatgagaacggcaatacgtgatattgcggaaggtgcggaaatgggattggaaacaggaagcgtgcccgggctttcatgcagtttatacggcggtgttgattttggggaggattacagggaagtgacaggcaggttggccgttccggagaaattgtatgtgtacgttgttccttccgaaatacggagtcttttaaaatcatggaagacctcattcgggagtgtgtctcgatatttgcctgagacaaaattataagtcgcctattcatggataagtatttggaatatatcaacgacatgctacgatgcgataaagagcatcggaatgacagactggaacttgcaaccggctgataatgcgaactattctaaaataagtgtggaaaacttgaagacatccgccggaaaaccttggaaaaagaagaaccggacaaagtctccgccttcaaaataatgctctattatgccacaggtgcggcattacttgtcattccggattggctgcccgtgaaatgtaacgataaatccaccgcccgccatcaagaaaacggccggtaccatatggcagacaatcgtagcggcagcccgtcttgggaacccgttgtcaccccaaaggattttactgatatattattatgtcagtcctttttcaaatcaaaatacagcaagcgggttttcaaaggttcatcttgcggaatatcataatattgcttttctatcacgtctgttttatagagtgggacgaaaccgtttctttcataatacctgagaatcttttcctcattgtatgcatccaccacgataaaacggcatcctgtcttgttgtcctcatgacggaaccagtcttttatgaaagccatcagttgccgtcctacgtggcttgatgtaccctgatattcccggttgacacccagtcttcctatcagcacggccggatagctgcgtccacgtttaggatttacaatattgcgttgcagcctatttttatcattgggggatattaatctggtcttgatactgtcattggacaaggtaaacaaggccacaatacgatgcgggatttcagccgtcacccaacaatatgttttcccaaggagttcatccgcatacagatcggcatcattgagaaaaaaatcatcaaggtcattctcgccacaagtgaaaggaaggcaattcctccgtacttccttgttataggcaagcatgacacaatcatcatataaagaaataccgtccattgctgttaattgaaccggaatgaacgggatttctccaatacttttcgcaatcgtttctttgcctccactgataaccggggtgttacctttgcggcgttcttgtctgcactgcgtacgaaatcttccgccgtagcgccctccaaaaccggaatgttcttgatagttatagccatgatattattttttgcaaaaatacaactttgttgttatacagccaaataatagcccgtcttccactcttttttccggaatgttcctccatatccggaaaagtctgtgccacgccgcctgttgcggtaagccgtttctcctaaggaaagggcaggcaataccggcggacgtggatatgggcaaaacaacccgcatatgcaatgcagagggagcaggagagccttcaccacagccggagaggaaagcggtctcatgccggggtacggcatgaaaaggggccctagacagttcttttccttgtcgcacatgcactacgtcggtcgcagttttcgccttctgaatccctcttacgtccgtccctgcgctttcggagcgtttttccggtagaaaatttcaccatgcggaaattttctgccggaaaccggagggaaaacgcggagtcccgcagggacggacgaactttgatgaggaaggggaaaaatcgttcctttcgtaaataccatttcctcagatggcatcgcatatttccttctccatcttttccagcttatgggacaggatttccatgtcgctgctgatcttctggttggttatccgggcatatatctgggtggttttcaaatccgtatgccccaaaagacggcttacggtctcgatgggcacaccgtgcgagagcagcacggtggtggcgttcgtatgccgggccacatgataggtcagccgtatcttgaaaccgcactgcctgccaagttccttcaatatggtgttgcatctgccgttgctcggtaccggaaatacatggtcgtccttggacagccccttatacttctctatgatgcgcttgggaacgtccagcaggcggatgttggactcggtgtttgtcttgcgacggcgggtgatgatccagaggttaccgtcgaagaaggtctggagccggtcggtcgtcagtgccttcacgtccgcgtatgctagtccggtgaacacagagaagatgaagaggtcgcgtaccagttcgcaggtcccgcttttcaccggggcctccatcagcgtctgtatctcacgctctgtcaggtagccccggtcaacgctctcgggggagttgatgtacccggcgaaggggttgaagggaagcgcgccgctgttgcgggcgatggagatgacgtgcttgagcccgatcatgtaaccccatacggtattggtgcggcatttcttctccgtacgcaggaaatactcgaagttgttgatgaaggtcaggttgagttccttcagggggatgtcgtcacggcggtatactttcgggacgaactcgcaaaggtgcctgtatatggtacggtagcggttgtatgttccctgcacgcggctgtgtcccactttcttgatgaactccccgttgtgctgctcgaagagcttcagcagcgtctcgcgtttcacgcccagcccgaggcaggcgtccctcagcctggcggcggtgacatagccgtcggactgcatcagttcctggtaacggcggttcacgtctacgcgtatccggtcaaccgccgcattgattttctgcgcctcggcactcttgcccgtggcacgtgccgttttcacgtcccaaagtttcgggggcacgtccagcttgcagctgaactgcttgatttcgccgtccaccgtaagacggcacatcagggggagatagccgttggctctctcgctgcccttcttcacgtagaagaggattttgaaggtcgatctgctcatactcgttttcatacttttttgatcgttacaaagttaatatcaagcgagttgtcctcaggtatgaaaaactgtgcaaattactgaaatagaatctgttgtgccgtttcttgttcctgttatatcagtaacgatatgggaactgaagtctttcgcagcttttatcggacctcctttttcagcttatgcagtattatgagttaaacacctaaccacttaatagactgcatttttgctgtattatcatcaaccttgctttttctttctgcgtttactttataaatcggacattccttcagcaactggttatgtaagtcagatgcaaaatattggacaagtaactaataaaggggttgaattaactatatcaggagatattctcagtggcagggattatgtgctttccgcaaatctttctttaggtatgaataaaatgaaagttgataaattaaatggtacagacaatgtgatttgggatcagaataaccgttggaaatcaagttacaatgattattgtttgaaggtgggtgaccaagtaggacttatttatggttttgtatatgatggtttatattcaatggatgaattctattttgatcccactaataacttgcaagcagtaccttggggatcaacggccgctgaaaacggaacttcgaaagatgcacctattatggatgcagacggtgtggaacatccaaaaacaataatcaatcagatttcaggagattctaattcaggcatagctactctgccgggcaaagtcaagttcaaggatttgaatggtgacggatatatcacagaagatgaccgtactgttataggtaataccaatccaaaagtgcagggaggttttggattaagcggacaatggaagggttttgattttgccatgaacttcaactttatgcttgattttgatgtgaataatgcgacagcttaccagctttcctcatccgaaagcaataagaataagttctacaatgtgctttccacatttgccgacaaaggttggcgttatacccgtgatggtgatggcgaatgcttgtacaaatgttactatattgatggttcgttggatatgtaccgtgaattaaacgaaggtaggacactttggaatccgacggatgtgacaaaaaaaataactcattcctattttatcgaggatggatcgtttctgcgttgtcaggatttgactgttggctatacgttacctggaaatctgacttctaaatgggggatttcgaaagctcgtttttatgtgtcagcctctaatttgtttattattactgggtattcgggttatgatcctgaagtggatattcagacaggattaacttgtggtatggactataaccgttacccacgtagtcgcagttttgtactaggtactaatattacattctaaatttgaaagcacatgaaattaaaaaatactttaataataggattagcaactttgactctaatatcatgcaatgatttccttgacgtggattctccatcaagttacaatgaggactttgtgttcagccaagaaacagaaattagccgtgcgttgaacggtgtttatgcttctatcttggtaggtgatctttatggcagtgcctatcagaaaacttttaatttgaacagtgatgttgatatgcagatgtatacaggtaatgtagcaacccataatagctatgcacgttttgattgtgacgatcaaggtggcgaaattgataaatattggagagcttcttataaagctattgaagatgctaaccgttttatccggggtgtagaaactggtccgctttataatgaagagaataccgctgttatgcagatgttgggcgaagccaagtgtcttcgtgctatggtttatcatgatctggtagtgatgttcggggatattcctttcactttcctgccagcctcacaattaggtgataattatgtgattcctgtaatgaatcgcgaagaaatccaaaataaacttattgaagatttgcaggatattgctcctaagatgtcttctactacaacaacaacagtagaacgtgcgtctaaggagtttgcttgggcattaattgcacgtattgcattgactgccggaggttattcacttcatccggataaaaataatgcaaatagttatggtgtgatgaaacgtccggaagattatcagaagtattatcaaatcgtaaaagaatatactagcctggttattgcttcggggacacactctgtaggcacttcttatcaagatatttttaccaaggaaagcaattttgaaattattgctaaaggtgatcctatttttgagattccttttgctaaggagtctacaggtaatacagggtattcccaaggacctacatcaaccgttaatgaaggaaagacattgggtaagaatgtatggggagaatctaaaggtgatatacgtttgagtgctttttaccgttattcattcgatgagaatgataagcgtcgagattttattaatggactttggtattatggtaacagtgctaataatgctactcaggattcttgtatgattcgtgcggattatactgtccataataataaatggtctaaattatgggcgaatgcgggacagtttaccaatttgagtgccagtaatacaggtattaacttcccttatatgcgttatacggatgttttgttgatgaatgccgaagctgttaatgagttggaaggacctactgccactgctcaggagtcacttcgtcaagtccatgcacgggcattcgatgaccaaagtgttgtttctgcctatattgctcaggtggcttcttctaaagaaacttttttgaaagccgtgcttgatgaacgtaaatgggagtttgcgggtgagaatatgcgctggagagatcttgtccgtaataatctttatggacaggaaattgtttatagttttttgcgctatctttctgtaggaatgtctaatgccggttcttctactggcttcgaagatgatatagctgaacatgatggtagtgcttatttggatgatcttcccgaatctatgtattaccatgttcttccacaaacggttgaatggcgtgtggatgtaaatcaagtttatggctatccttatcccaataagatattggatatgctctatatttataatccttacaaatcagctaatcaaccagcgacagctttggtagctgttgatggagcaacttggaagatggcggaattttatcagtggagcaatgattcggagcctactaaccaatgtaaatattcattctatggatatattcgtcatacagaacaaggaatgattgtgttggtcaaagatggaacagaatcaccactggatggtaattctgttcctgaggtgaatgatttacctcctgtacgttatattttaccttatcctaatgcggctatccaacgctcagcaggtgtatacaagaactattatggctataaataatttataaaaggacagaatgatgaaaaaaatatttttatatgcattaatgttattttcaggtttctcatgtatttcgtgttctgatgatgagaaaggaatggcaaatatagatagagaatggatgactatgttcatttgtgataataatagaggaaaaggggatgactatgcttataattgtaaagcagagggaccgaatggcaatgatattcatctttattggtatggagtgaataactgtgcgggctaccagattcgtcaggcactacagccaaatgtttcgggtggtgcagatgcttggggtacatctgccgaaaacggtcttttgttactagataccattgtaggaccggaggtccttgatttagttattaaagatcaacagtattccactgattatcgttttgctattcgcgtgttatcaacaaaagatgataatgtgactgatttttcacatgcatccaaatggtatggacatggtgatggcagacagtgggcagaatggatgggcattaccacttctgatcgatatgcaactccattctgtgtctatgtagatgcttctaagactacacagactactatgcgtgtgatgttgaatcgtgctttcaaaactgtaacagaaggggtatcagacgatgataaggctatttatcgtgaaaaatttcagcttgatgctaacgataattttgtttatcagtggttggaagtagatccgtctcctaataatcctgaatcaacagtgaatgaaaaatggagaaaatataaattaaccgatgaggattttgaaaagggatatgtagatattgacggacttcagaaaaactctgtttatgtgattaatgttcgcaacgagaatgtgaaggtaaaatgggatgcatattacaatacttgttctgcccgctcagacggagaaccgggagagcctattttagtaactcatgacttaagtgctccaagtcgtgaccggtttgattcagatgaagcttatcaaaatgctttgatacagcacgaggctgctctgaaatacaatgcaatgcgtattgatttccttttaacagacttcatttccgatgtaaatttagccgaaggacagacttattatttggaaggtggaaagacttattgtatgtttgataatttaactacctgcaaaggttttgttcttcgtactcgtcctgaggatgtagcagcaggtaaacgtgctaaagtattgttaggtggtatgcatatgacaggtactaatgttaattctatgaatttgatgttcgggcgccagccacaagctggagaaggaggagaaatttatatgaagatgctcgaattttatgatattgatttcgattgtccaatggctcttacttatggtgataatgttgccggtttgggttcggctacaggtaattatttcattaatatgttttctaatggtatggctgtacatttggaaagttttgtggtgaaaaattgtactttcaagcgtctggtacgtgggttcattcgtgagcaggggcctaattacaaaatttgggatcatgtcttgatagaggataaccagttctttgactgtggctattatagtaatggtgccggaggttatccatggattgccggttccgggaataatgcgaattctaatttatataaggactttgtggttcgtggaaacactttctatgattgtccgttcccttcatttttcagtgaaaccaagcagagtgcatggaagggaggggcatggaatataacgtttgaaaacaatactttggttaactggaacactcgtgcggcaggaaatattttcaatatgcgtaatattccagatggaagtacttatacggtgaaaaataacctgattgttttgaccaagcaggacggtgatgtccgaaagatgactatggcaggagctgatatccgtaagacaatgactatggcagacggtacagccggacatgtgacattgaattttgacaataattattctacaaatacttttttatccaacggacaaatttttagcaataatccatggactgcgactaaaaataattttggcaccttggtcaacaatggttctgctactttaaatggaacattggaagtttttgttgatgatatttctccattagaactgatggtaagtccaaatccaccacataaggctactgctgataacgatcaatatatgcatcgtgcagatgcacttgatggtacggctggagagcatggtgtaaacttgtattacaatcagacaggtaaagttatggagtcaaaaatttatcagttgaacattggtgcggctaaatggcgtaatggttctgctagatagtagaatggggtttgataagttttatagttattataatgtgaatgtcttctgagaatctttggattttgaaagacagatatttgatagaaaagccgatctgtgatagataggcttttttatgtataggtaaaggggcagagtatcaaaaattgtataggtttgatgatgtctgtgcaaaatctgcctgaaaaagaccaaatattctctgtattcagattggaaaacgcataattttgtttgctggtttttatcaaaacatataggaataatgaaaaatacattcaaaaaagtgtttattggctttatggcttttgccatggcaaccggctcctttgcgcagcaaagagctcataaaaaggataatgagtcgtatcctaaggaatggaaacaaatagcacgtatggagcaggattctttctttctgacagatgaagctcggcggattgctgaaaatgtattggcttttcaacgctgtacgggcggttggccgaagaatatagatatggcccgccgcatgaatgataaagagctggctaaagtgataaaggataaatcacgtcgtgatgattctacgatagataataatgccacaactgcccagatgatttttttagcccgtctttataggcagactaaggatatacgttatcgggatgctttcctccagggagtggaatatttgctgagtggtcaatacgaaaacggaggatggccgcaattctggcccggtccgcgtggttatcaggtacatattacttttaatgacgatgccattgtcaatacattgaatatgatacgtgatatgatgaatcacaaagcgccttatgaggatgatttgatagacaagactttgtgtgtacgtttgggaaaagcctttaataaaggaatagagtgtatactggctacacaaattataaaggatggagaaccttctgtgtggtgtcagcagaatgatagggaaacattgaagcctgcaccggcacgtgcatatgagttgccgtcttattgttcggcggagagtgccggaattgtgcgtctgctcatggaattacctgcacccgacgcacgtgtgaagcgggcggttcacggagccatgaaatggtttgacaggtataaacttaccggtttgaaatgcgagcgtatcgtgctggcaaatggtgagcgggatactcgtcttgtggaagatcctcaagccaagcctatttgggcgcgttattatgatttgaaatattgtgaaccgtatgtatgtgaccgtgatgggctgccacgtcgccatttggaagaaataggaacagaacgtcgtaacggatatagttggtacaatagcagaccggctgagctttttgccatatacaatgcatgggcggacaaatatgatccgaagcataaagtggcaatcagtctggcaaccaaaggagcgaatgaaaacgggcttattgaaatgtatcgtcgtcccatggcagagcgtacggcttttgatgtggtggtaaagccgggagagagtattcaggcagctattgaaaaggctccggaaattccgacagtaccttttaaaatcttattgttgaacggaacgtatcatcaaaaagtgattattgacaggcctaatattgttttggtgggggaaaaccgtgacagtacgcggattgtcttggctgaaacagcccagacacgtgccatcacggaatatcatggacgtccggtaggcaatggtgtcattgtgttgcaggaaggtgcggatgattgtgttattagcggactgactgtttacaacaattacggaactgccgttgaaaatacgaccatccatcagatggcgatttttggacgtgccactcgtaccatcatcatcaacagtaatgtatgggccgatggaaacgatgccctttccttgtgggcgcccggaagcaatggtatgtattatcatgccgatctctatcttcgttgtccgggtgtggattttctttgtcctcgcggatggtgctatgccacacgctgccatttttatggtgatagccgtgccatgatttggcatgacggacgaggtgacaagaacaagaaactggttattaccaattcttcatttgatgctaagacaccgacacttttaggacgctatcatcatgattcccagttttatctcatcaaatgtaaaatgtcgaagaatgtgcttgacgggaatattcattatgcttattcggataaagtgcttgatccctgtccgtgggggctacgtacctattattatggttgtacccgtgaaggagggcatagtggctggttaaacgataatttgaaggaggcggagaatgctccggagtttcatggcgttaccgccaagtggacattcaatggcaaatgggaccccgaacaacgtatcagagatctttggaatgtgttggcctactaatttaacagtttgtaatatgaaaatgccccctgttttatgctgtattgtttttttgtttgtgtcaatgttatctgctgttgcccgacagcaggagaagccccgggttattgtcactacggatggtgagattgacgatcaaagttctatgattcgttttcttatgtattcttctgattatgatgtcgcaggcattgttcaagtcaatggggtacagaaagacggacatagtaaagataaatggatcgaatcacaaattgccaaatatgcggaatgtctgcctaatttgaggaaacataatcccgattatcccgatgctgaatatttgctaagtgtcttggcggttggtaatgagaacagagaggacttgcataaattgcctcctttactgtctgatagcgagggggcacagctcatcataaggacattgcttgattctgatccgaggcctgttcatattttagcatggggtggagccaacacccaggccaatgccttatggcagatcaagcagaaatattctgctgcagaatgggcaaaagcggtatcaaaagccagattatattgtatttggtatcaggacggcggtggaaaatggatagaacagaatcttcctgaaatcattatttatgaatcgggcgcaccggatcatgatggagatatgtatgggattacatgagtgtggattattattttaagaacagacttagtaaaaattcaaaagagttgcaacagatcatggataaaccttggttggctgaccatattaagaatgggcacggaccactgtgtgccgcctatcctcaggaatataccagtgagggggatactccttcttttatgcctcttatacgtaatggacttgaacagcatacagactatacattaggaggatggggaggacgcccggagtataaaaatggcaatcacatgcaagatgggaatgatttgaaaaacggtgtgccggattcgcattatactttccagcgttggttgcctgctatacaaaatgactgggcggctcgtgccgactggtgcgtggctgatgaatattcaaaggcaaatcatcaacctgttgcccggatattgggagaaagtgtacgcacagtccggccgggagaaaaaataatactggatgcctctccttcatttgaccctgataaaaattcattgtcttaccaatggtggcaatatcgggaagcaggcagtgtgcaaacaaaggtggctataaagcacgtcgatgagaagaggacggagataattgtaccggataatccgggcaaacagttacatttgatacttgaacttacagataatggaacgcctaatctaaagtcttataaaagagtgattctgaatgtgaattggacttcctgtatgaattttcatccgtactgtcatgttgttttgaacaggcctacacttcttccatccgctccagctcccatccccggaactgtatgataatacagtgcagcttcgtgttctgcaccaactgccatacccggggtgcggcagcatattcgttaatctgtttcaccgcttcctgccattgcgtccgggctttctcttccgtgtccttcaccgacagatatttcagttcaagaatatagctatgcttcacctcgtagcgcatcaggtccggcatgaggaagaggtcgcagtaaccgtggctcagttccatttccggagccatcaggtaataagcgtttacgctgaggtaggcggtgaagaaaccctgtatatttcgctcgccttccatggcactgcgtacagatgaattttccttgtaggcatgggcaatgaattccagtgtttcgcgccaatggccttcgtaagccatttcatcgaacaggtccatcaaattgttcaggttgatatggcgtttgtcctggtactcctccagcatgaattcgtaatactgtttgcgcacattatagttggggatactcaataccaagcggctgccgcgtgtggcagtgatggtcaacatgccataatagaagagcaggctggggaagatttcgggtttggcgatttccttggccgggaaggtggtgatcaggttggtgataatttgcccttcttcggtgattttacgtaatacgcccttgcggttgccgtccagcttgtccagctggattagtttcttcattttgttgtagtccgtacgggtgttgggatctatcatctctttaggagatttgcccagcgtgatgtaattgcgcaggtagtaaagtaccatgtcgcaattgaacattttcgggtcgcgttccaggctttcttctgcgaaacagtaattattataccacggtttcatctcccggatcattgcttcgatgtccgcgtcgatcgggagctgtccggcatccttataatattggaacatggtgcgcacgtccgtttcgctgaatcccagcatcatgttgaactggtagtcggtactgatattccagccgatgttgaatccgctggtcaggtcgtccaaggtgacggggctgacgccggtcatgaagatgcgctcgaacatgcctttgaatttcttgaatatttcacggtagaatccgctggcatgggtcagggcatgataaatgtcttttccctgctcgttcagaacgatgttggtaaagttatcgtattcgtcgatgatgaggtaaagtctcattccggattcagccgcatgcaggttcaggtagttcaacttgctgacaaagtcgggctgttcttccatcttttgtgcaaatccgggaaaataataaggctcatacactttgccgaacaggtccatcaccatgccgcaatagttattgaaattttcttccagtgaaccgcttccgccactggcgcgcgagaaatcaagatacaccacctgaaattttccttgcaggggggtggggcggctgcctatccatagattgccgaagcgtttctggaacttttctttttgtgctatgtcataatacgcacgcagcatactcaaaaagatactcttgccgaagcggcggggacggataaagaacaggttccggggctgtttttccagcaaaggcagatacatggttttatctacatagtacatgttctgctctgccacttccacgaagttggcaatgccataggggatttcttttatattttccatcattgcttctgttgtctttagttcgtatccggatgccaatacaacaaagatagtctattcttcctgaaggaacaaaggaaataaagtttttaatagaaagaagatgttcaaggtaagttatgcgtttgaaagaaaattctttattactccccgctagatttctactgggtcgaaaaaaagggcgtgccaaaagccatgtttattatttagaccttttggcacaccctcttggtggattctgaaatcagtttcttatttcttctctgccgcggcatgtggatagtcaatcgtataatgcagtccgcgactctctttccgttccattgcctgacgggtgatcaaatacccgatgttaatcatgttacgcagttcgcaaagttcgcgtgaagccttacagcgtttgaaaagacgctcggtttcttcatataaaatatccaatcggttccaagcacggattaatcgcgtattactgcgcacaatacctacataagcttccataatctggttcacctctttcatgctttgggttatcagtacccgttcttcattgttcatggttccttcatcgttccattcggggatatcctcattgaagtcataccggtcgagtacatttagtgcatgtttggctgccgcgtccgcataaaccactgcttctatcagcgaattggaagccagacggttacctccgtgcagaccggtacatgaacattcgccgatagcatacaaacggttgatgctgctctgtccgtccagatcgactttgatacctccgcacagataatgagcagccggagccacaggaatatagtccttagtaatatcaatgcctaggctgaggcattttttataaatattggggaaatgtttttttgtttcttccggatctttatgcgtcacatccagatatacatgatcttcaccgcgctgcttcatttcgttatcaatggcacgtgctacgatatcacgtggggccaatgacaggcgtggatcatatttttgcatgaattcttcgccactttgattctttaagacagcaccgtaaccgcgcatggcttcggtgatgaggaaactgggacggtctcccggatggaagagggcggtgggatggaattgtataaattccatgtcctttactgctcctttggcacggtacaccatagcaatgccgtctcccgtagctactagtggattggttgtattgcggtataccgcttcgcatccgcctgttgccattacagttactttggacaggaacgtatccacttctcctgttttctcattcaatacgtaagcaccgaaacatttgatgcctggtgtatggcgggtgacgataattcccaaatgatgctgggtaatgatttctaccgcatagtgatctgtaaatatggtaatattgggatgagcttttaccgcttctatcaagctggtttgtatttcagctcctgtattgtctttgtggtgcaggatacggaactcggaatggcctccttctttgtggaggtcgaattctccatcctcttttttatcaaaatccactccccattttatcagttcctggatttgtgcaggtgcttctcgcactactttttctacagccgcgcggtcactgatccaatcgccggcaatcatcgtgtcttcaatgtgtttctcgaaattgtctactttcaagttggtaacagatgctatacctccctgagcaaaataggtattggcttcttccagtcctgctttacaaatcagggcgactttacctttgtgagctactttcagtgcgaagctcattccggcaagtcctgagccgataacaaggaaatcgaattttttaaccatgataatatgctttatgggtgcaaagctacgaaaaacctttattcattgtaccttttgctcttgtttttactatttttttcgtgaagaataaacgaaatagataatgcaagtatgaaattaaaagtgtaactttctgcatttttaaatagaataggatggaaaacaataaagaaatcattcacgaaagtgaggtaaaagaacttataattgagttgaggggtgagaaagtactgatagaccgggatgtagctaagctttatggcgtagaaaccagggatataaataaagcagtaaaaaataatgcagataaattccctgaaaattactgttttagcttgcaattatctgaaaaacaggaactggtggaaaatttccaccggttagaaagtttgaagtattcaaccgttgtccccaaagcttttacagaacggggattgtatatgttggctactatattaaaaggtccgagagctaccgcaactacttttgccattatcgaatcattctttaagttaaggacattagtacggaatgtaaatatcatggctaccgagtatgatgaggaaaagaggaagagtctggtacaacgtagtggagaactgctgaatgaactgctgactgatgagggtgatataacagaaacggaatcttctatcgaattaaatttgtatgctttgaagatgaaacgtacagtaaagaggacaaaaaaaggataaattctcttattctgcgccgtaatgaggtcgataaacgataaatttattatctttcgggcaaattacaataagatgatgaatcgaatttttcatgtgaagatagcaggaggcacttatctgtttctgatactgctgacagccgtcatggtatttgctttctggtgtatgaaggcaatgataggattggtggtggcattggggctgatcattaccattgaacgtattatccattctacttatacgctgactgcggatggaaagctggtggtgtattatggtcgtttttataaagggaagaccattcccttgactgacattacggatgtggagctgaaacgaagttccggattcggtggaattatgccttcgaaatatgtattgatacattatgagaagaaaaatttattgtcattggttcctgtaaagccggaagaatttatcaatgcgttggtgaagcggctggagcataggatagaggaggaataatgttgaaggttttgaacagataaaaactaattaacccaaaataaataccatgaaatatcaaattgcaatcatcggtggaggtcccgcagggtatactgctgccgaagctgccggaaaggcaggactgagtgttgtattgttcgaaaaaagaagtctgggcggtgtctgcctgaatgagggatgtattcctaccaagaccttgctttattcggctaaagtatatgattatgcgaaacatgcttcaaagtatgccgtgaatgtgtctgaagcttcttttgatttaggaaagattgtggcgcgtaaatcaaaggtggttcgtaagctggtattgggaatcaaggcaaaactgactgcgcatcaggtaaatatagtaacgggagaagccacgattgtagataagaataccatccaatgcggtggggaaacctacgaatgtgagaatttgctgctgtgtaccggcagtgaaacatttattcctcctattccgggagtggaaaacgtggattactggacgcaccgtgatgcactggataataaagaagtacctgcttcattgactattgtcggcggtggagtgatcggtatggaatttgcttctttcttcaccagtttgggagtacaggtgactgtggtcgaaatgttggatgaaatcctgggtggcatggataaagagctgtcggccatgctccgggctgaatatgccaaaaaaggaatcaagttcctgctcagtacgaaagtagtaggggtatccaaaggggagaccggtattactgtgtcatacgaaaatgcagatggagcaggaactgttacagctgataagttattgatgagtgtaggccgtcgtccggtgacaaaaggtttcggactggaaaatctgaatttggaatggacggaacgcagatgcatcaaagtagatgaacatttgcaatcttctgtccccggtgtctatgtatgcggtgatttgaacggagtctctttgttggcacataccgccgtgcgtgaggcggaagtggctgtccatcatattacaggtaaggaagatgcgatgagttatcgtgccataccgggtgtggtctatacaaatcctgagattgccggggtaggtatgagcgaggaagctttgcaggccgcaggtattccttatcgagccgttaagttgccgatggcttactccgggcgttttgtagccgagaatgaaggagtgaacggtgtctgcaaagttttggcagccgaagacggtactgtattgggagcgcatatgttgggtaatcctgcttccgagctgattgtattggcaggtatggctattgaggatggtaagaccatagaggattggaaacgatatgtattccctcatcctactgtgggtgagatattcagggaactataatgaaacgagttttatttttctttttactgattttatctattcacttcataaacgcccagccgctatctcagcggctggacgctttactgcatgaggaagttctgaaaacatccgaagtgggtattgccgtattcgatctgaccaccgggaaatccgtttaccgttatcaggacgagaaactataccgtcctgcttctgttgagaagataatcacttcggttaccgccttggcgcaactgggagcggattataccatggataccggtctccgttatcgtggaaagatagaaaatgacacgttgaaaggcagtctgtatctgataggcggttttgatccggaatttatggacgaggatctggaccgtctggtagatgcgttggcaagtcaaggcatccgttatgtgacagacacccttgcggcggatgtttccatgacagactcggtttattggggttccggctggtgttgggacgatactccttactccttccagccctatctttcccctctcatgctgaataggggctgcgtggatgtatcggtttctcctgctcagaaggactcgttgcctaaagtcgtttgtacgccggtttccgattattatcaggttcataatcacggggtgagccgtaatccgcaagccgggaagctgaaaatcacccgcaactggctcagcaatggcaatatcattaccgtttccggaaatgtttcttatccctatactgagaaattgaatgtatatacttccaaagatttctttttccatacctttgtcagccgtttgcgcagcaaaggaattgaagcgcgaacttgcacgtatgccgattgtcctgtaacggccgacagtatagttacgctttataccgtccgaagaccactcaaggaagtgttggaaagagctttgaagaaaagtgataacctgtgcgccgaatcaatgttttatcatttggctgccaagcgttccctgcataaacgggtgacgggagaagatggaaccgatgccattcacgcctttatgaaaacagctttagggtttaacccggagaactataagatagcggacggcagcggtgtttccgtttataattatatctctccacgtttactgttggagtatttgaaatatgcctactatcatcgggaaatttttcttcctttctatgagtccctgcccatagccggagtggacggtactttacaaaaccggatgaagcagaccaaggcccgtggaaatgtgcatgcaaaaacaggttctgtaaccggagtcagctcgctggcaggctatgtaaaagctgctgacggacatcaactggcctttgttatcatcaatcagaatgtactgaaattaagccgggcgcgtgcgttccaagataagttttgtgatattttatctcgttgaatttgagtttttgaatgttctgaaacgtattaagtagcagattttgcatataataggacaaaatttatacctattctgaacgatttttgcagcatcggaacaagattgtttcgtaactttgcccaagtcgaaataattcggaatactataaaaacataaaatagctgcttatgaagacaaattatgaaatccgttatgccgcgcatcccgaagatgccaaaggctatgacacccaaaggatacgacgggatttcttaatggaaaaagtattttcggacaatgaggtgaacatggtttattccatgtatgaccgcatgattgtaggaggagccagacccgtaggggaggtattgaagctggaggctatcgatccgttgaaagcgccttatttccttacccgccgtgaaatggggatcttcaatgtgggcggtcccggtgtggtcaaagccggagatgccgtgttcgaactggattataaagaagcgctttatctgggttcgggagaccgggaagtgacttttgaaagtaaagatgtcaagaaccctgccaaattctattttaactctgttaccgctcatcgtaactatcccgataaaaaagtgaccaaggcagatgccatcgttgctgaaatgggttcattggaagggtccaaccatcgttgcatcaacaagatgctggtcagtcaggtattgcctacctgccagttgcagatgggaatgaccgaactgaaaccgggaagtgtgtggaacaccatgccggcgcacgtgcacagccgccgtatggaagcctacttctatttcgaagtgcccgatgaacacgctgtttgccattttatgggagaagtggatgaaacccgtcatatatggatgaaaggcgatcaggcagtcttgtctcccgaatggtctatccatagtgcggcggcaacacacaactatacctttatctggggtatgggtggagagaatctggattacggtgatcaggacttctcattgattacagacttgaaataaatcatataacttcattaatttaataatataagtatcatgaatcagtatttgaatttttctttggaaggtaaagtagctcttgtaacaggcgcttcttatggtatcggttttgctattgcatctgcttttgcagaacagggcgcaaccatctgtttcaacgacatcaatcaggaattggtggataaaggtctggcttcttacgctgaaaaaggaatcaaggcacacggatatgtatgcgatgttactgacgaacctgccgtacaggctatggttgccactattgcaaaagaagtaggtaccatcgatattcttgtaaacaatgccggtattatccgtcgcgttccgatgcacgagatggaagctgccgatttccgccgtgttattgatattgacttgaatgctccgttcattgtttctaaagcggttttgcctgcgatgatggaaaaaggacacggaaaaatcatcaatatctgctctatgatgtctgagttgggtcgtgaaaccgtttctgcatacgctgccgctaaaggtggtttgaagatgttgacccgtaacatctgttctgaatacggagaatacaacattcagtgtaatggtatcggtccgggctatatcgctactccgcaaacagctccgttacgtgaaatccagcccgatggaagtcgtcatccgtttgatacattcatctgtgccaagactccggccggccgttggttggatccgcaggaattgaccggtcctgccgtattccttgcatctgaagcatctaatgccgtcaatggccatattctctatgtagatggcggtattctggcctacattggtaagcagcctaaataattagtagatataaatagaaagaatctgcttgtgtctttgttgatacttgcagattctttgtatttttgtctttcagttcgacaaacaataaatagtatgaaaaaaatctttttagcagtcgcaacggcgttagctatgttttcctgttcgcaaaaggagccggtgactgtcactataaccaatccgctttccattgacagaaatggggaaatggtggaaatctctatggctgaaataacaggcaaactacaattacccgatacggcacaggttatcgtattggacgagaacgggcttgaagtaccttatcagataacatacgatgatatgcttatctttcctgcttcggtgaaaggggatgcctcggctgtttatacaattgcagaaggaactccgcagccggtggatgtggttgcttgcgggcgtcaatatcccgaacgtttggatgatgtggcatgggagaatgaccgtgccgcttatcgtgcatacggtcctgctttgcaggagaagggcgagcgtgcctttggttatgatatctggactaaaagtgtgtccgaaccggtagtggaggatcgttatgacggtgacttgaaccggggtatttcttatcatgtagatcatggaaacggaatggactgctatgcagtgggcccgactctgggtggaggaacagctgctttattccctgatagtaccattgtttatccctattgttacaaggattgtgaaatcttggataacggtccgctccgattcacagctaagttggtctataatccgttggttgtaaaaggggattcaagtgtgatagaaacgcgtatcatttctttggacaaggggtcgcagttgaacaagactgtggtttcttttgacaatttgcaggaaatcactccggtggtgaccggcattgtattgcacaaacagaatcctatgggatatagttttgatgcagacgcaggctatatagcttatgcagactctacggagaatgctgccaataacaatggagtgatttacataggagccgtattcccggctaccgtcaaaggagcgtttgcccaagtgttctccgaaaaggaacggaaggaacgtggggatgctttgggccatgtgttggcggttaatgattatgaaccgggagccgagtatatttattattggggatcaggctggagcaaatatggtttcgaagccgataccgattggaataaatatttggaagaatatgcccggaagatacgtaatccattggcagttgccataaaataatacatatacaagagggtatgcgtatacgccacgaaaaaaacaaggtatttggctttatcagtcaaataccttgaattcatagccttgttccaacagccattctatggcccggggcaaggcgtatttcatgtttttctctgccttgatggagtcatggaaagtaatgatggagccattcctcacataatgttttaccttcctcagtacctgtcttccattcagcttgttgctatagtcacgggtaaccaagtcccacattacaatctggtatttatgccgcagcaccatgtactgcatccagcgcatgtggccatgtggcggacggaacaggttggtatggatcagctcgtttgctttgtccgtattggccagatagttcttgcttcggtattcgaatccccggatatggttaaaagtatgatttcccaaacgatgtccccgttctacaatcatctggaattccttgggatgcttgcgcacattgtcgcccaccaaaaagaaggtagccttgatattgtacttgtctaataaatcgagtacccacggtgtgatttcgggaatcggcccgtcatcgaaagtcagatagaccgctttttcattcttgtccattcgccagaaggcgcgtggataaagccagcggagtatcagcgggggttgttctataaacatgaatgtgtgtgcttttgttggttatacaaatataaaggtgtggattcaccgcagaatccacaccttttatttactttctgcctgctccgccgcctacacgtttgttgaacacctcatagaggtcttcaaacttcttggcatagtggcttgccatatctgattttttctgttgttcaccttcaccttgtacaccgccggcagcatttgcgcgggcaaggctcttgttgatctcatccagaatatagaaatagcgcagacagtcctcgtatgaaccttgcaggcgttggtcatccagactcaggtaccaggtgatgtattccaccgatttgtttgccagatcattcagaatggcttctcccttttctttttcacctaacgccagataatcgtcggccatttcttttgaactgctcatgatgtaatcgtggggcacggtggtgcttgggattacttccgaacagtagtcaagggctttcaacgccttgtctttcttgccttcttttatcaactgggtagccagctgtataaacatacggcggtgggtctggcacatacgcatcacagtctcgtcgatatagatatccgggttgttgattcctccgaacttgaacttgttcatcaggttatcgtacattttctcgctgtcgatgcgtgcgttcagccgggtggtgttgaacggggtgatgcggtaggcaagaccttcctgcatgaagttgttgcccaaattcagatgattgtcgctacccaccgtaatagccatgtacaacggacgttcccagttggtatttgccagcatctcaagcatcatcagctcgctcttgtacagcatacgtttgcctttcagggagatactcatgtaatcggggatttcaccatgcagggagtcgggaatcatcatgcccgagcgtttcactgcctccttgtccagcttgatgacgatgctgtccgtcggtatcagctgtaaaccttctttgggtgagcgtacccagtatttcagaatatttttcaattcatacgggttgtctccgaattccttggcggcttcttccgggttctgcttgtagaagttattgatgctttccatcacttccggacgtacagccactccttcattatgcccctgtacatattccagacggctccattcgataggcactgccggagagtcgtatgcctgacgcttcatttggtcgatgtaccagtccgtttgcaggtaactcaggttacatacgcgtacatcggtacggaaaccttccgtttcctggttgtaccacaaggggaaagtatcgttgtcaccattggtaaagataatcgggttaccttcttcctgtacggtgctcaggtagttttgtccgaagtcgcgtgccacataacggttgctgcggtcgtggtcgtcccacgtctggctcaccatttggatgggtacgaacagacaaactacagttgcaatgacggaagccggtttctcacccagtttgccttgcagccattgggcaatacccgccacacccatgcctatccagatggcaaatgcatagaacgaacctgcgtatgcatagtcacgttcgcggggctgcatcggggtctggttcaaataaagcacgatggccagaccggtcatgaagaacaggaagaatacgatccagaattgctggatacctaccggttcttctatctcttccccattcggagtcgtgatacgttttgtcttgtaagcctgccagaacagaccgataagtcccaaaatcaacggcaggcaatagaatacattgtgccctttgttgtttttcaggtcggaggggagcaggctttggtcgcccaccaggaacttgtccacaaacggtattccggtaatccagttgccatgttctatttcaccctgtccctgtatgtcattctggcgtccggcaaagttccacatgaaatatctccagtacatgtagttcaactggtagataaagaagaacttgatgttatcccattgggtcgggactttcaccatcaccatctgtccgcactggtcgtaaggaacctgcacgcctttgatgccgcccagccagtcttcgtaggcctgtgcgtgtgcatcgctgtacatgcgcgggaagagcatattttgtgcatacttgtaatcggtcttatgacgcactacttcgtagctgtccttttcatcgggagtcgctttctccttccgttgatacacgggagcgccttccgtcacatcatatacacatcctccgtccacttctttcagtgccggtttggaggcgtatgtctgtccgtagaacaaaggacgggttccatattgctcgcggcccaggtattctcctaaagtgaagatgtcttccggagagttctggtccatcggagtattggcggtagagcggatcacaatcaaggcgtatgaggagtatcctaccataatcatcatgatgcacagcaaagaggtgtttaaagtacgtgcgctaatctgatatttcttgttcaaatcagcaaacagataaacgcccaagattcctagtatgataatacctatcaaggcgctgctccatccgtagccatagaaggggatgcccagcatggcgatagttaccatgaaggagatattcatgcgtttgcggctcttttccgtatagctttcgtaaacaccccagataatggatgcggcgagtagaatgatgtagactatcagaccgctgttgaaaggcataccgaaactgttgacgaacagcagttcgaaccatcctcccacttttactacgcccggcacgataccgtacagcactgctgcaaccaacaccatggagcctgtaagtgccaacagactgcctttgaggttggcatcgggattctttttataatagtacaccagtacaatggccggaatacacaataagttcagcaagtgcacaccgatggaaagtccggtcaggtaagcaatcagaaccagccagcggtcgctgtgaggctcgttggcaacggattcccattttagaatcaaccagaatacgactgcggtgaagaggctggagtaagcgtatacctcgccttctacggcactgaaccagaaggtgtcgctccatgtataagccaaggctcccaccagtcctgaccccataatggtaatgagtttgcccaaggtcatctccttgtcatcggggcatatcagttttttcaccagatgggttatactccagaaaaggaacaggatacaagccgcactcatcagggcgctcatggtattgaccattctggctacttgactggggtcgcttgtaaattggctgaataagttggcggtaagcataaagaagggtgcaccgggcgggtggcctacctctaatttatagccggtggtgatgaactccggacaatcccagaaactggctgtcggttctatagtcatacagtaagtaaaagctgcgatgacaaaagctaaccaacctaccaggttgttgactaatttgtactgtttcatgaatatattattgtttcgttaacgttcaatgggcgcaaagatacgaaagaaagttggaatagggaggcaatggtctgttatttagtgttatccttagggaatgcggcagaaaatgtttctttcagtccttaacggaatttctatgttttattgctggtttgtatactgtgttctgaaatttcagtttgtacagatgaaggaaacctttggattcctaacctttttctactctatggttaagcttgattgatggttaggttaaggtcttttatacggtaaaccagtatagaccgctacagtggactgtacagtctgctatggtagtccgtacggtctgttgcagtggactgtacggagcactgccggcgactgtagaagtctgccgtaagaaaatgcttaatgataaggtggatagggcttaacctgccgcatgaaaaggcttaggtcacgataatcggatttattcgtcgtgatgatggcatttcaagatgcggtgagggaagtttccatgtcctaacagttcgatggggcatccgaaatgctcttccagccattcggtgggtacttccgtatcgggatgataatccagcgtttcgttgacgcacgctatggtttttacattttgcagcacagtgcctatgtcatggcttaccaggatgatggcccgttccttgttgatttcttccagcagggagtagagtttggcctcaaaccgtttgtcaatgtaggtattgggttcgtccagaatgacaacctcagggtttgaaaccaaggcgcgtcccaagagcgcgcgttgcagttgtcctccgctcagttcgccgatggcacggctttccaaaccttccagacccatgcgggcaataatccggctcaccagttcgcgctgttcgggggtgtagcggtggaacagggatttctgtttgttgagccccgataataccacctcatatacggagatggggaatttcttgtcaatactgttgtattgtggtaagtatcccatggctatttcgggtacttccttttcgttcttatagaaacggacactgcccgaagcgggcttcagtaaccctagtatgatcttgatcagtgtggtttttccgccaccattgggaccgattacaccaaggaagtcacgttcatataccgtgagattgacgtgactcagtactgtcttctcatcgtaagaagcggaaatatctgtaagttgtataatgggattcgtcataaggctctgttatttggcaagtgcatttgctacattgatcatctcttcccgccattcataacttagcggattaatgggaacaacggtgactcccagttcatctgctatcagccgggcattgcgggtatcgaattcctgttggacaaaaataacccgggcattgtcccggcggcaggtttctatcagttctttcagatgggcgggtgagggttcctttcctccttcttctatgctgatttgctttaatccgtagtccctagcaaaataactgagtgccggatgatagataaggaaagtggtatcggcattctgtagccggtcacgaacgtccgtatctgtctgtgcgataatttgttgcagactgtccagccgatgcttgaaataaggttcgtttgcactgtccagttcactcagggcggagtagatattacgggcgattactgaggcattgcgtgcggagttccatatatgaggttctatacccccttcgtgatgatggtcaccgtggttgtgtcctgtttcgtgtatgacgtctattccttttgaggtatcgaatactttcagatgaggggcattcgtggtcagtttatccatccaggcttgttcgaaaccgatatagccgatgcgcaggtaggcggtgcttttatccagattgaccagttgttggggggtagggtcgtaggtttcggggctgcttcctttcggaaccatgctgactatcttgaatttatcgcctgcaatggtttctgtgaaatagcgcaagggctccagggtgacagtcagggtcggttttgtggaagtggactgtttactgtcacaggcggtaaacaggcacactatcagtaccatgcagcacgaacaaaggatacttttgccgggatgcaatggggaaaatatgtgatgtctggttctcatgaatgttatcttttctgtttaacaacaacaaatatacgcaaattgctcattaatcgggtacaaatactccccaaattgctcaattgataagcaatttcagtctggttagggcttttcatacggctattctgtggctgtatgagaagccttggtttcaggtaagagattctatatggcattctatgtactctttatcgttctctataaatatgcgctttatatttggtgggaagtgtcttgtcatttgtcaatctttttaagatgccatataaggctcttgtattcgtgaagaataagatttgtaaaaaaatcctttcaatctttgttcatgtatttatcttattatatgttaagagaaggaatagggactgattgtggatgattgaaaatcaatgggttattgtatgtatggaagatgaaaaaagtataaatctcttagtaagagatcgacatttcacgtgcaaaaataaggaaagttttgataactagtacacttttcgcggaaaaaatatggaatattgtgaaaaaagtatttcttctggttctaccggctctgatttaatcttgtatctgtatagttaatattttgatttaaagcctgttatcgtctgtttgtagatctcttactaagagatctgcataaaaggccaataagaacgaataacgagtttagatggaatacctgtttctgagacgtaaaaagacgagcagcacttctgtaaggcagaagacattgctctatcgtgccgccggccgcgaatggacagcgcggttctcgtcactgtcggatgtccgtccggcagacagccttatatataaaggtatattgtatcagttggagatacgccgggcgttcctcgattcctctctttcgttaaagaaactgagtatgatgctcgaaacaaaccagacttacctgagcaatgcggtgaaccgctacttcggttgtcatctgaaggagttgcttaaccgctaccgggtggaatacgctaaggagctgcttcgcaacggcggttgtccgctgggcgaggttccgtcacggagcggtttcggttcgaagagtcctttctatctggctttcgtccgtcagacgggtatgactccgaaacggtatgcggcgcgcgagaggaacctggtgaacttggaaatagagaatgaagtccttttataacagtatatgtataaccaatttttagttttttaaatttataaatttaaatctttatttatgaacaaaaagtttttaagtgcagttctgttcggagccttgatggtttcgtcaacaggaacatttgtgtcttgtaaagactatgatgaggacattgaccgcatcgacaaggaactggtcgatatcaagtcggctctttcagctttacaggcaaaagttgatgctggtaagtatgttaccaacgtagtgaagaacggtgacggtatcactgtaacctggagtgacaattctacaagtaccattgaaactatcaaaggtgacaagggtgaagacggtaagaatggtacagttgtgaccatcattgacggttactgggcatttgacggtgtgaaatctgaatatcctgcaaaaggagataagggtgacaagggtgaccagggcgaaccgggtgatgctgccgctgccggacatgatgcaaagattagcgaaaacggttactggatggtatgggataccgaaaaggctgcatacgttgaaacagaatatattgccggtggtgcggtagctgcacaagtaaaaggtggctggaacattactgtaaaggatgaaaatggtgatgaacagactatttttattccgagcagtgctactatgggttatatggatgtcttgaatggtgctaatccgatgcatgcactttatggaattaatgagaaggatgttgagtacggaccagccaaaaaaactttgaagaaaggtttgtacaccactcttgatcgcgacttggaagttgtggttaatcctcagggaacagatgcttctgcttattcattcaacttgatgaactctgccaatgtggatacagaattgccgtttaaggatgctgttccgtttaagggtgtattgactagagccacttctgaaaatgcagtatgggtattgcctcatgactttgtccgttatgaaaatattgatgatgccagaacgaagaactatctgttgttcaaggctaatgacggtgcaaaacacgctttgtctctgactgctactttgaatgaaacaataattaaaactccgtatgatttgagtgctcagttgaagaagattggcgaagttaatgtaggtttgcgcaacttggaaaattgtgcagttaatgtagattatactcctattgtttcttatatttctccgtctgtagatgcagctgctgtatatgactactggattactttggaacaatctgccaagaacttgaagaacgcacagttgtatggtgtggaaatagataaagaaggtcatagcttcaagttcacaagagaaacaggagtaaataactacattgagtttgtttacaactacattttgatggacggtactatcgtacaaggcgataaagatgcgcctcacttctttgcttatcagcgtgaagaaatggcaaatgctcatgaaattactttggaacgtctgtatactccgatggatgctaagttaattgttgaaaacgacaaggatcctaattataatcctgaactgagacctactactggttcttggtctgctaatgagaagcaagtatttgctcttaatactaaggcttattcattggataaaataatcaatgaaatgagtgctatagaaaaggctgtatggaagagtgccgttgaagctggacgcattgatttcgaattgattggtggtgaaggcgaaaacaatgaatattgggataactggacaaaagggtataatgttcgttatgctattgtggacaacaccataacattccagttcgttgtatctgaaggatatccgtataacttcactttgaagaacgcttatcagttgactttgacagtgaaagatgaagacaccaacacacctgttgcttcgatcatcttgccattcgaattcactcagccgactttggatattactcgtgtaaacggtgagaaggctatctggaatgacaagaagaatgtattgagcatttatggtgacttggtaaaagaaggcgatgtagaaattatgagtgttccattctatgaagcatttactactgcatatgctaaacaatatactgtatttggttctacagctcagtactatactttgagccataatgaaaatgtagataattggtttacttattccggttatgaagtgttaggtcaagattatgctacgagacttcagaatattcctttgactaatatcgtatattcaagtcttgcaaaagaatggaatacacgtactcttgttggaaatgtaactactggagaagctaatcttccgatagttgccaactacaggttctacggagtatatccggcaactaaggaacaagtatcagactttactctgagattcgctagcttgatgggtgacgctaagaaggtagaagctaagaaagaatttacttctaacaatgtaactcgtgaagtggttctgacagatgctgactttactttggtggatgctttggatgatacattctatctgttcgacggtgttaaggctgacggcaatgtggataagcgttctgatatgaacctccgtcaaggatttgaagaaggtactgaaggattcgctacaaacttcacgctggctaatgctaatgcatctgcatactattacaagaacggtaacaaagttgctatccctgtttctgtaggtacggttaacactaatgctaaattcgtaactaatgctaataccaagaccagagcttgggaaccaggcactatcagtgcaacagatgttatcgttacagatcttggtgctaacgaagctgtgaagagtgaaggctatgctgctgttcctggtggtatcatgatccagttgccttctagcattggtactacagaacctgttactatcgaattcaaactgaaagatgtattcggtgtaactaagactctgaaagtagttgttaaagctgcaaaataaacttggttaaaaaactgcttccctctcgtgggggagcggttccttctaaacaaatgaatttatcaggaaacgatacaatcccaattcggataaagttcattttttcagcaagataagactttctccgacaggagaatcttatataataaaaactttagatttataaaacagaatctctggcttgtgacaagccggagattttttatgtatataacggcaatcatctcagcgtggagaaagaatatgaagaatctatgacggattcagcgatgaatgtttcatggtaatttgctgataaatatgcagttatgcgtatatgacggatttgaaggattttacaacggttttactgttttaggtgaaacttgaccattcatcagtttcggtcctagaagtttaatcagacttggttgcccgcagtatctcgcgttttccccccggagggccgggaaggcgttctactgtgaatccggctgtttgcagcatccttcttaccacccctttagcacagtaagttgtcaggatacctccttcattcaataccttgtataaagtatcgaaaagagattgttcccacatttcgggttgtttttcgggagcgaaggcatcaaagtagatgatatcgtataagggaacggcgggacggctgccttcctccgggttgaaaagccgggtaaaatcatcttcaattttatgtaatgtgaaccaaggggatacctctgtttctgtgttccagggcgcccggtgaatggcgtaataatcctcctcatgctgtttgccgatcaggcgggggtagtccagttgcttcaaggtttcttcggctaacggatagcgttcgataccggtataatgtactttccgtcgggtctcttctgctgaaagcagtgtcagaaaggcattcagccctgttcctagtcctatctccagaatgtagggctcggaaacgggagaatgctttaatcccatttcgataaaaatatgttgtgactccgtcagtgcccctttcaccgaatgataatgttcgtccagttcgggtacatagagggtataacttccatctgctgtttgttccagtttcataattttaatgcattaaagcggaggcttccaatactccccataccaataaggcgtagcggagtatctttccgatggtcatagcgagaatgacaatccatatattggcacgcatcatgcccaatacaatggatatggcacttcccaaaatagggataaaggcgaagaaagccatccaggcaccccgtccgtgtacaaaccgctccgcacggtccatcttctctttttttacatgaaaatatttctcgatccattccatattgcccagatgtcccatccagtagcaggtcatgcctccggcaacattgccggcggtggcggcggttatactgatcaccgggtctaagcccaacggacctacacaggctgccaatacggcctccgaactgaaggggagaacacttccggctataaaagagcctagaaaaagaccccaatatccccagtcgatcaggaattgaagaattgcatccataaattgtatatagttagaactattaatagaacaaatgtaatgatgaaaaagatgccggtaaagcggttgtgggttaaagtaaataaatgtcctgttaaaatggatcctacaatgacctgcatctgcaacaggatgtcgaaatgctgtggctgtaagatacccagtaaataaatccaggcttcaacggcgatcaggaaaaaaaggaatatacgcgtgcgtaccttgtctaaataagaaacatggaaataatgcacgctgctgaccagtgatatcaaggtgatgattccacaggatatgattctgtccatccctaatgtcccataactgatgggttgaaaatgaataagctcctgtaaagggtgatagaagagattcattttgtcgtaatagaacgcatagccgaaaaagagccagtagggcacacagagtcctgtaagtccggcaaagaaacttttgagtgacagggatctgaaactgatcatccccaaatagaacagaggtacaaaataaagcaactgtggaaacaacaggcttcccagtccgatgaaaaagaaagcgtggaatatacttcccgccggatagggagattcgtagctgctgaataattgggaaatagcgatcagaaaagtgagtggcgcaaaaacggcatactggaaggaatgcagaaacaggcaggccgtggacaggaatacgtaaaagctgacatgcaaggtactgcgtgtccgtatcagcgtgaaggcggtgtttatctcgatcagcagataggcagtcaaagcacagaccagcaaattgattacatcctgccattcattgcccgtgatgatccggagaagcaggcatataaggatggcaacagggaaggtgaatcttccctttgccatatctatttggaatttgtcatagcctgccatgggttgatagtccgctgattacaggtcgaatccaatatctgaacggaaatatttcttgtcgaaattgattttcttcgcattggcgaatgattgtgccaaggcttcttctttattggcaccgtaggagctgactgcaatgacacgtccgccgctagtgactacctgtccgtctttcagtgctgttcctgcatggaatacaatgctgttttcaatttcttctactccgctgatggcaaatcccttgtcataatgttccggatatccgccggataccagcatgacgcatactgccgaacgggggtctatctccaggactttttcattcagattgcctgttgccactccttcaagcagttccaccaagtcactcttgatgcgcagcatgacactttccgtttccgggtcgcccatgcgtacattgtattcaatgaccatcggttcgccttttacattaatcagaccgaagaagataaagcctttatagtcgatgccttctgctgccagtccttctactgtggggcggatgatacgttcttccactttttccatccatgctttgtcggcaaacggaacaggagatacactacccataccaccggtgttcagccctttgtcgccttcgccgatgcgtttgtagtcttttgcttcgggcagaatcttgtagttctttccatcggtcagaacgaatacggaacattctataccgctcaggaattcttcaatcactacggtggcggaagcgtcaccgaacattccgctcagcatttctttcaattctttcttggcttcttccagggtgggcagaatcagtacgccttttccggcgcaaagaccgtcggctttcagtacgtatggagcttccaatgtttccagaaaggctagtccttcttccagatttgcggcagtgatacttttgtaaccggctgtcgggatattatggcgttgcatgaagcctttggcgaactccttgctgccttccagtaccgcacccgcttttgaaggcccgataacaggaatgtttttcagcgcttcatcttttttgaaatagtcatagattcctttgactaacgggtcttcgggacctaccactaccatatctatattattctttactacaaactctctgattgctgtaaagtcatctgctttaatcgctacattctcgcctacattacttgtgccggcatttcccggggcgatatagagtttctcgattttgggactttgagcaatcttccatgccagggcgtgttcacgtccgcctgagcctaatagcaacagtttcataatcttatcttttgtttattttaagtggtcttcaaaatagcgtgtaatgcgttcatacaagtgcacacggtcgcgtccgaacatattatgaccgtcacccggatacataaagaaatcgggttgggttccggcatcaatgcaggcacggaggaaactgatgctgtgctggggaacacaagtggggtcattggcgccaatgatcacttccaagcgtcctttcaggtttccggctctcagcttcaggttggcgttcttgtagccttcggggttggtttgcggagtatccatgtagcgttcgccgtacattacttcgtagtaagcccagtcgatgacaggaccgccggctactcctactttgaatagttcggggtaagtcagcatcaagttggtggtcatgaaaccaccgaagctccaaccatgtacgccaatgcggttattgtccacataacccaatgattttaagaaatccactccttttacctggtctttcatctcttcggttcccaattggcggaacgtacagttctcaaattccagtccccggttgtcactgccccggttgtcaacggtcagcatgacgtaacccagttgtgccatgtaaatatcccatccgcgggcgtcatagttgcggttgttgtggattagttgggcatgtggtccgccatacacgtagactacggccgggtattttttgttggggtcaaaattcaccggctttatcaggcggtagtataagtcggtcttgccgtcggctgccttgagggtaccgacagtgatttcgggcatattgtatgcttccaacggattggtggcggtcaacaggctgatagtctttccctttccggaagtgggaacgatctcgatattccggggaatggtgaaagaagtataattgtctatcacatagttgccgttaccggacagttgtacatgatgcataccgtctttattgccgatgaggcggcgtttgcctgtctttacattcacagcgtatgcgttgctctgcaaaggggaaacctctgtgctcatgatgatgacttccttggtcttttcattgaatccgaggatgttttgtactacccagttgccttgggtaagctgtctggtcttgtagctttcccggtaagaacctccggccgcggctccatgtgattccggatatacggaagtcttggtgtccatcaggtaaagatggttgtagccgtcgcgctggctctgatagataaacttcgtgtggtcccatggcagaaagacgatgggatgttggggttctacatatttagtatgctcctcttcgtaaagggggttatttttcagtggctctcctgtttccgcgtcatagcagcatagcagggcatggttctggtcacggttcagttcaatgacataaacgcttttctcgtcaggactccagctgatattggtgaaataacggtcggtagggtctccggctttcagataaactgttttttgggtctccggattgtagatgccgacagtcactttgtggctggtcattcctgccatcggatacttgtccggctccagtgtcgctatgcgggtggaggtatttacttgtggataatcggttaccatgctttcgtccatgcggtagaaagcaagcagatttcctttcggactccagaaagtacctttcgagataccaaattcctgacggtgtacactttgtccgcatacgatgcctttcggttcgtcggtgacttgttgcgttttcccgtcggcagtcgttacaaacagattgttgtcaagggtataagccaatgaacggctttccttgttccagtcctggttggcggctttaggagagagaggctgactccatattatttcctttttagttaaatcgatcagcactttattggatgtggtatttaccagcatcatcttttcagcgtatgggaaagatgcattcctgaagtggttgattttccctaattccttgtttgccaacagttcattcacttcctgcaaagtgataagtacgttttccttcccatttgccggctggatggtttttacctcttctatgtcggcgttgatgcatacatctccccaccattgcaaaccatacaggttttgtggaagcaggttataataattgtttcctcccggcatcaagtcttccagtgtgaaacttttcttgtcttgtgcccatgttacagatgaagccatgattaataaggcaatcagattgattaattttctcataactgtttattcttctgtcttttccttattgtcgtcaaatttacggggactgcttttgaaattgtcgcggccttcacgtctgtcaccaaagttgcggtgttctcctcttttgaaatcgccacgtccctcacgtttgtcatcaaaagagcgtctttctctgcgctctcctcctttgtactctccgtgttcttcacgtctgttgtcaaaactacgacgttctctgcgttctccatattctaccttttccgtgttacggcgcgggcggatttcttcccggcggggcttgaattcccgatcggcgttctcactacggaattctttgaatttgccgttgaataattggtatttgcggaattcacattccaacgaaccgttgaacagggggatttttatagaaggctttaaaccaatctggtcgaaacattcttcacggtaacttagtacccatgcatcattgccggtgaaagagtgtttcagacgttcgcctatcatttgatacaggcccagcaaatcattggttgagatacgttctccataaggagggttggtgatgatgatgcttttttctttgggttgctcaaattgctggaacggttggatttttaagataatctccttgctcagtccggctgctttcacattgtgagtggcaatttcatttgctttaggattattgtcatatccaaaaatcttatgtgtgaactcacgttcctgtgagtcgtcattgtagatgcggtcaaatagttcctgatcaaaatcgttccacttttcaaaagcgaactccttacggaatacgccgggagcgatgttacgtgctatcagggcggcttcgataggtattgttcctgaaccgcacatcgggtctatcaaatcacattcgcctttccatccggtcatcaggatcataccggctgccagtacctcattcaaaggagcttctacagcttcctggcgataaccccggcggtggagtgactcgcccgaactatccagtgacagagtgcatttattttcggctatatggatgttcagtgccacatcgggatggttgatgcgtaccgaggggcgctctcctgtcttttcacggaaatagtccacaatggcgtcttttactttgtaggctacgaacttggagtgacggaactcgttcgagaaaaccacagcgtctacggcaaaacttttatctttatccaagaagtcttcccacgcaatggccttgatagcttcgtaaacttcatcggcattcttcgcctcaaaatgtttgatgggtttcaggatgcggatggcagtacgcaggcagaagtttgccctatacatcatttctttatcgcccgtaaaggctaccatgcgtcttcctacttctatattgctggctcccagctcggtgagttcttttgccagtacttcttccagtccctggaaagtcttggcgattagctcgaattcttccttcatcttaaatgataattacgtaatttcaattgatgggacaaatttaatgattttctgtttgctaatcaattatttagagaattaatctgtttgatgaagcaaaaaagaggatgaaatcggggcgtccacgctccttgccggggtctttatttacctttgattataaaaattctttgaaaacggaattgggtatatctgtggaataaattgacaaaatatgtatccggcaatgtaattgttatcctatagaaataaattctacacaggaatttgccatttttgctgaatcaagaaacttaaatagaaatcagaatgaaaatggaattgacggatgagaaacgtaagggatatgtggtttgtgctttaatgatactggtctcttgtttgtatttggcttatttggggtacagtctctaccgtatggggcatgcttaggacaaaatgaaaccatatctgtatcacacaggtatggtttctgtaagagaaattctatgattaataggttgagtgacttttatgcgaattcttctgccagatagacttcgtttatttcgcagaaaaactcatcggcgatatctgacagggtttccaatgcttcttcggcagtttcgccgtaagtgcagcattggtggtagtctgttaaaaaggcgtaatattccccgtagggtgtacattctatctgatattcattgcttttaagttccatatatacctccttttttatcgtactgcaaatatcttgtttatctgttacaagaaggtgtacaggaagttactgttttattaaaaagtttgctgccatactactttttagaccattttgtgatgtcagcatttctatgatggcaaaggggatttattcgtctttgttttttcgctgtacgatacgtgatccggcaggtacattttctgttacccaaatattacctcctacggtagcacccttgccaatagtaacacgccctaaaatggttgcattggaatatacaatgacatcgtcttctaaaataggatggcgtggaatgcctttaatgggatttccattattgtctagcggaaagcttttagctcctaatgttaccccttgatagagtttcacattatttccgatgatgctggtcgctccgattactacacctgtaccgtggtcgatagtgaaatggtgtcctatttgtgcccccggatgaatatcgataccggtttccgaatgtgccatttctgtaatgaagcgggggattaaaggtacacccagtattaacagctcatgtgcgatgcggtaattgctgatagcgcggatagccggatagcaactgatgatttcaccaaagcatgtggcggcgggatcaccataatatgcggcttctacatcggtagccagaatgcggcggagttcgggcagtttactgatgaaacgagctgccagcaaagaggctgtttctctgcacggttcattgtcatcggttgcatttttactgttttcctgtccgaagcaaagtcctgccagaatttgttcggtcagcagaccgaacagggtttctacatttacaccgatatggtagttgatggtatggctgttaacggtggaattaccaaagtagccggggaagataatggcgcgtgccaattctactatcttgtatagggatttggcagatggtaaaggatctccatctttgtgttggtggaataatcctttataggactggctttcagataattcatctactgcctgcgttaatatgttcgtgtaattgaatgtagtcatgaactgaatgctttagaaggacaaaagtaagtaaattctatattattgccaataaatagaatgaatattgatgttaatcctttatttttgcagaaaaaagggaatatttatggtaaataagaaaaatccatttgcttttaaggcaaaacaggaaactaaaaagaagtccggtggtaaacggatcggcaaatcgaagccggataaagcgaataatcagttgaatagaagagtgaagtaaatgaaattattgtcttgttgtaggggaagaaccagtctgcccctacaacaggatgctaatctttatttctcgaccaaagcgaaatcaagttgttttttctccagattggcgcgggccactttaatggtaaccggatctcccaaactgaattttttgtgatgccggcgtcccgtcagacaatagttcttttcatcgaaatcataatagtcatcaccaaggtcacgcatgggaatcataccttcgcacttgttttcgttcagttccacataaagtccccattcggtaactccggaaatgactccgtcgaactccatgcctaggcgttcacccataaactctacttgtttgtattttacagaggcacgttccgcattggcggcgatttgttccatttcagaactatggtcacacaattcttcgtatttcgcttcctgtaccgtacgtcctcctgccagatagcgggtgagcagacgatgaaccatcatatccggaaaacggcggataggtgaggtaaagtgagtataatagtcaaatgccagaccatagtggccaatattatgtgtggaataacgggccttttgcatggcacgcaaggatacggtttccaccagattttgttctttcttgttctttatgtcgtccagtaaacgattgatggatttggatatctcagttttgctacccgatgtacgtatcttatatccgaagcgattgataaaccaattcaagttctccagtttatcggggtccggaaggtcgtggatacgataagggaatactttggctttcttgtttttaggtactttaccgattttttcggcaaccgtgcggttggccaacaacataaattcctctatcaacttattggcctctttggattctttgaagtagacactgagcggtttgccggtttcgtctatctcaaatttcacttctacgcggtcaaagtcaatagcaccggcagccaatctttgtttacgcaggatttgtgccagtttgttcagttccagaatttcttctttgtagtcgccttcacccgtttcaatcactttttgcgcctcctcataggtgaaacggcggtcgctctttataatggtgtgcacgatgcgcgagtctttcacctctcccttttcattcatattgaaaatgacggagaatgccagtttctcttcgtcggggcggagggaacagatgaagttacacagccgttcgggcaacatggggatggtacggtctaccagataaacggaagtagcgcgtttttcagcttctttgtcgataacgcctccttcttttacataatgagtaacatcggcaatgtgtacgcctacttcccatagtcccggtttgatgagacggatggagagcgcgtcatcaaagtcctttgcatctttagggtcaatggtgaaagttgttacattgcggaaatcttcacgttctgcatagtccgcctcggaaatctctgccggaatcttttcggcagcggtttctacattcttgggatatacgtaaggtaagccgaattcggccagaatggcatgcatttcagttgtgttttctcctgcttttcccaaaatatcaatgacttgtcctatcgggttttttgcctcttcgggccattctacaattttcacgaccgctttgtccccattctttccacctttcagcttatctttcgggataaaaatatcatttgccagagtgcggttctcggtcagcagaaaggcgtagaatttctctactttcagtgtgccgacaaaagtatcgttggcacgttccagaatctctatcacttcaccttccgggttccggttcttacgtttggcaaagagggctatttttactttgtcattattcatggcatgtgccgaattacgttcggctatgaaaatggtttctccaccatcatcggggatgaaggagttcttgccgttgcttttacgctgaaagacaccagtcataatcaggccgtggtcgttcagtttgtagtgtcctttttctacttcttgcagaaaatcatcctcaatcatttcagtaatgatgtcggcacaaagcattttaagaggatgtgtagtaaggttcagactgcttgataattgtttcagactgaatgtttcgttcggttttgtgtggaataagcttatcagtcgttcagacatttcgctttttttcatgcgtttccctgcttttttttctttctttttagccataaggggatatatttatgtattatgtgctacaaagtaaacaaaataattggaatagcggttcaatagatacattaaatttggttgaatctaaatgaaacgtgctatctttgtccgttctaaaacaattgttatgactgaacttgataagaaaatcagggaaaaagaaatttatagagttacattagtggggagtttcgttaatttcttgctggttatttttaaattccttgccggaattgcagggcatagtgctgctatgttggcagatgcagttcattctctatctgacttcattacggacgtagtagtgattctttttgtacgtatatccaataaaccagtggacaagagccatgattatggtcatgggaaatatgaaacattggctactgctttcattggtatggcattattgggggtaggatttggaatattgtggaatggagcaacagatatattggttttcctacgaggtggggaacttcgtcaaccgggaatgttggcattggttgctgccattatttctattctgttgaaggaaatactttatcaatatacagtcagagtggggaaaagatgccactcacaggctgttgtggcgaatgcgtggcatcataggagtgatgcattatcatccattggtacggctgccggtattggcggagcgattttactcggtcctcattgggcggtactcgatcctattgccgctgtgacagtcagtttctttattatgcgggtttccatcaggctgctggttccttgcctggatgaattgctggaaaagtctttgccggatagtgtggaacgtgagatagaggggattgtgttatcttttgatggagtcagcgaaccgcatcatttacgcacgcggcgcatcggaaacaattatgctatagagattcatatacgcatggatgggaacatttctctgcataaagcgcacgagacggcaactggtattgaacatagattgaaagaaaagtttggagaggatactcatgtgggtattcatgtggaaccggtgaaataacatacgaagaatgaataacgaagaatttgcacaaaagaacacttgctgcttaaagaaagtattggtaaccggagcaagcggatttattggcagtttcctggtggaaggaggattggagagagagatgcaggtatgggctggtgtacgtaaaagcagtagtcgtacctatttgaaagatcctcgcattcaatttgccgaattggattttgctcatcccggaagattgacggagcaattggctgttcataaacaattgcatgggggatgggattatatcattcattgtgccggtgtaactaaatgccgccataaggacgaatttgacaaaggcaattatgtctatacccgtaattttgtagaagctttgagaaccttggacatggttccccggcaatttgtctatatcagttcacttagtattttcggtcctattcatgaagataattatgcacccatcagtgagcgtgatacggcaatgcccaatacggcatatggggtcagtaagctaaagtcggaacattacctgcaatcattgaatgattttccgacagtgattttccgtcctactggagtttatggtcctcgtgaacgcgattattttctgatggcgaagtctatcaagcagcatatagactttgctcctggttttaaaagacaggatcttacttttatttatgtgagggatttggtacaagctgtttatttggcaatagaacatggagtgcggcagcgcgcctattttgttagtgacggaaatgtctattccagccgtactttttctgatttgatacaaaaagaacttggtaatccgtgggttatacacattaaatgcccattatttattttaaaagttgtatctttgctcgctgaattttcagcgcgttgcctgggaaaggtaagtacgctgaatgctgacaaatataaaataatgaaacaacgtaattggcaatgcgatatttcacccttggtggaagaactgggatatcgtcctgagtaccctttagacaagggagtaaaggaaatcattgcatggtataagaaagaaggatggctttaaatttattcaaacgggtagacagtgtgaaaggattgtttgccgttgagagcattagtctgatatataatgccctcacgaccataatggttttaatattatttcctcgtatggaccaccctgtaattatgcttttggagcgtgcaggcattgtggccattacgtttgcattaatatatttgtatcgcaagtatccgtgtaaacttacggcatttatacgaatggctgtgcagatggcatttttagcgtattggtatcccgatacctttgaatttaatcgtctttttcccaatctggataacttcttcgcttcggcggagcagtttttgttccgttgccagccttcggtagaatttagtgaacattttccttccatgtggttcagtgaaccatttaatatggggtatttcgcttattatccaatgattgggattgtgactatttattatttcttgtttcgttttgagtggtttgaaaaggtttcttttgtgctggtcacttcgttttttatctattatcttatttatatattggttccggttgccggtccgcaattctatttccctgctatcggaatggacaatgtgatggcgcagcatttccctgctatcggtgattatttcaataataatgatattctgctgcccggtcccggttttgatcatggtttcttctttaatttggtagaggcctcacaggaagtgggggaacgccctactgctgcttttcctagttcgcatgtcggtatatctaccattgtgatgattatggcctatcgcgttaataagaaactatgttatttcttggcaccgttctacgtacttctatgctgtgctacggtctatattcaggcgcattatttggtggatgttattgccggctggatttcggcggtatgtatttatattgtggctacttatatgtataagcgttggtttgcttctgtagtcttccaacttgtgctgaaatagttttaaaaagtatataaaagcgtacagggtgtccattttcggacaccctgttttgtttataccttgttgattttcagtgataaatgttgctggcatgaatattgctttaaaaataatggctaaacgttgcaacgtttggcatagaaataacgtctaatgaataaaacaaaaatagtatgagaaaattagtatcaactttaatggcggtgacccttatgttagtgtctgccacagcatgtgcagagagaataactcctagtaagaactatgttaccaaaaaagtgaatgtgggtagttttaatgctatctctaccagttcttcggtggatgtaatctatactcaaagttccggtggacaggatgtggaaatatatgctccggacaatttggtggactatattgatgtccgtgtagagggtggagtacttaaggttggttttaaatcaccaagaaacaatttttcaataaacggaaaatataaaaaggaagtaagagtttctgctccggctgtgaacagcttgaaagcttccagttccggtgatattattataaagaatggactgaaaacgagtgggaaagttactgttaaggctagcagtagcggtgatgtaacaggaagcactatttcttgtgatgattttgcggctaccgctaatagttcgggtgatgtgattctggaaaaggtatcttgtacgaatttctctgctgatgccagtagctcgggtgatgtatctgtcaagaatctgaacgctgctgatgtatctgctgatgccagctcttccggagatgtgattttggcaggtatttgtgagaacgcttcttacagagcctgtagtagtggggatgtaaaggcaaaaggtatgaaggcggtcaatgtaactgccagtgccagttcctctggtgatgtggaatgttatgtgaccggttcgctgactgcgaaagcatccagtagtggtgaggtggcttataaaggcaatcctaaagatattgatttctctcccaaaagaggtttgcgtaaaatggaatagataatgtgttaatgctacaatatattaatgtgccaattggctgtgctgtattccgcatggcaattggcacattagcatattagcacattgtagcattaagaattcattccgtaattccccctgatataatccaagatactgaaaagttctttcacggtttcggcacggagcatggcgatacgtgtctctttaaagttggggatgcctttaaataagggagaagcagccagatggcggcgtacatgaagaataccgcggcgttcgtcaagcagattcacactgtccaacacttcctgacggagtacattcagccgccactcaaaagaaagggccgggagttccttaccggtttctatataatgttttacttccttgaatatccacgggcgtccaaagctggctcggccaatcataatagcgtccactccatactggtcaaaacactctttggcacgttgtggcgtagttatatccccgtttccaatgataggtatatgcatacggggattcttttttacttcacctattaaactccagtccgcttcaccagtgtacatttgtgcacgggtgcgtccatgaatggtcagtgcttcaatgccgcaatcttgtaattgttctgccaaatctactataattttatgctcattgtcccagcctagacgtgtttttacagtaacgggaatttttacagtgtccacaacagcacgggtaatttccaacatcagcgggatattttgcagcatacctgcaccggctcctttaccggcaacgcgttttacaggacagccaaaattaatatccaggatgtcaggatgcgcctcttccactattttcgccgctgctaccattgtttccgtgtctctgccgtaaatctggatggctacggggcgttcctcatcgttgatattcagcttctgcatcgttttacctaccgagcgtatcaatgcatctgccgatacaaattcggtatataccatatcagcaccgaacttcttgcacatcaggcgaaaagcggggtctgttacatcttccatcggagccaggaaaatagggtatctgcccaggtctatatttctaatcttcattgttgtatgtttatctttgggttacagaaaagtcagattcatttgagtattaatttataatctgtgtgaatctgtgtaatctgtggtgaaatcaggctgcaaaaatacggaaaaaagcctacctttgcacatatattaatcaaaagaataatgaaagcttctataaaagactttgaaataatggctcctgtaggttcacgtgagtcgctggcggcagccatacaggcaggtgcggattctatttacttcggaattgagagtctgaatatgcgtgcacgttctgccagtacatttactgtcaatgatttacgcgagatagcacagatctgtgataaacatggcatcaagagctatcttacgatcaataccattatttatgatgaagatattgctttgatgcgtaccattgtggatgcggctaaggaggcaggcatcagtgccgtgattgctgcggatgtggcggtaatggcttattgttgcgaggtggggcaggaagtacacctttccacccaattaaatatcagtaatgccggagcgttgaaattttatgctcgctttgccgatgtagtggtattggcacgtgaattgaatttgaagcaggtgcgggtgatttatgatactatccagaaggaacaaattaaaggtccgaatggagaattggtccgtattgagatgttctgccacggggcactctgtatggcagtgtcgggcaagtgttatctcagtttgcatgagatgaatgcttctgctaaccggggggcttgtatgcagatatgtcgccgtgcatacgatgtgaaggataaagagagtgatattgaactggaggtggacaataaatacatcatgtctcctaaagatttgaaaactattcattttatggatgagatgatagaggctggcgtgcgtgtcttcaagatcgaagggcgtgcccgaggacctgagtatgtacgtaccgtggtggaatgttacaaagaagctatttgttcttatctggagggcacttttaccgaggagaagaagcaggcttgggatgaacggctgaagaccgtattcaatcgggggttctggaatgggtattatttaggacagcgtttgggtgaatggagtaagaactatggttcggaggctactgagcgtaaagtgtatgtgggtaagggaatcaagtacttttctaatattggcgttgcagagtttctggtggaagctgctgagatgaaagtaggggataagcttctgatcacaggacctactacaggagcggtatttctgacgttggatgaggcgcgtgtggatttgaaaccggtggatgtggtaagaaaaggtcaacatgtatcctttaaagtacccgataaggtacgtcctagtgacaagctttataagttggtttctcctgaggatttgaagaagaaataaaacagaaagaatgtgtttctaaagagatattgaaatttaaatctcttatgattaaaatccgaagagaagctcccttttcttattttatgtagcaatgaataaagtaagaaagggtagggtatcatgatgatacagattattataaagctgtttcattaatctattttgagttatcctttggaactataaatttattaatgaatactctcttttgatttgtttgagaacaataaaaaacccgtaacagttcattttgctacgggtttttactttgttagagtttgctgttatttggtataaattgagagtttaggatgatccttgtaaaggtttttgttcgccagctcttccgaatccgtaattcggtacaaataatatttactgtttggacagaatgcacttttatcggggaaattgaagaaacgatgtccttgagtctttttcttcagggtgtgagtttgtccgttttcatcagtgtaaatatagtcaatgggaccttcgggatatgctttgcggactacggtctgttggttacggataatgtctatcaaactgaatccttccccccataattctttgcggcgttctagccaaatagtttccaatagatcctgttgtgaaagatttgtatgaatggtttttgcccctctggctgtttttaaatcatttaatttgttaattgcatctggatcattcagatgtgcttttgcttctgcatttatcaaataaatttcggcaacgcgcatcaatacgatatcaccaagttggttttcgatatcgcggaatctgaatttagagttacgcatccatacataggctgctgatgcgacgtcagctcccggatctgtggcccagaacagcatttctttacgataatcaccatcttcgaacaaatcacggaagtaagggtctacattgaagctataatagtatgatcctttagttgtagtatctaaataatggaattgataactggcattactttgatcgttggtttgggcatgcccccaaatccattctttattgtctacagaattgaatccggctttatattcactttcggtcattaaataattgtttttagttaacaatttgtccgagtaagttttagctttctcccattgacgagcataaagacaggcacgtgagagaatacctaggacaacttcattgtcaattttgtgtttggcgtcacgtacataagtttcgggaataagttctaatgcttcttctaaatcgttgatggattgcgcatatacttcactgacacttgatgcgggttttccttctgctgcaattgtttcatcggtggactgtgtatagacaggtgcacatacagcgtccgggtctttatcaatagcaaaggaataacaagaggccaggtgcaggtataagaaaccgcgtaaagccaatgcttgtcctttaattcggtttctgtcggcttgcgtgccttcggcagcatcaatattgtctaatacgccattgcagtcgttgattacacggtatgctaaaagccagctcaaggtgtttgtgcctccttttccataaattgcagaaaactcattatgtgtcctaaagccatatttgctatttaacactacatcagaacccattgcgtcatttgcacgtagcattgctccatagccagggttggcgtaggaattgaaagtttccatcaggtagttccaaccaccattaagtactttttcggcatctcctgttttaccgaaaacagaaccggcatctacataagttgtaggaattgtatccaaatcgcaggaagtgagcattatacttcccagtgcgactgaaaatatatatttaaaaatagttttcatattcttctttctgtattaaagtttcacattgataccgaatgaaattgttttcattgccggatagcgatagtaagtagagcctccgaaagtttgctctgggtctagaccttgttgtttggctaatgtcagcatattttctgcttgaaaaaatatgcttgcatctttcagtgtcaatgtgttcagcaatgacttcggcagattgtaagagaatgtaatattcttcaaacgtaagtatgaacggtcaactaagaaccggtttgaagagtttgtccatgaacttttgggagaagtagtcagacgcggtacatcggtatagggattttcaggagtccaacgatctaacatatctacgctccaaccggtgcctgtaggtccttggctcatcaatgaaactttatccccattatagattttaccaccaatggaataagagaataaaaatgataatgtaaaatccttgaatgagagatctgattgaagaccgccggtccaatctggtagtgaattgccgcattttactttgtcgtccggggtggttgatgaatagtcttctgtggttatcttttctccgttggtattgtaacgataccacgtaggattaccattttcaggattgacaccagcccattctactaaatagaagtcatataacgatcctcctttcacccatttcttgttgccactccacatttcttcggcaggcaatgaggttattttgtttttataggtagtagcattaaaagaaagtttccatttccaatctttagtcatgataggatatcctgagatttggaattcccatccataattcttgatagcaccaatattttcgtccatacttgagaagcctgaagatggaactaagtctttagagaataataaatctttggaacgacgttcaaaatattctattgtaccatttagacgattgttccagaaaccaaaatccaagccgatattagtatttagattggtttcccatgataaattaggagttgccagacgataagcgtgcaaaccggattcaccgaggttattgcgtatggaatagagcgcctgatacgcataataacctacctggtcattaccttgtgctccgtagctggcacgcaatgacaaattggatagccagtctgatgtgtccttcataaactcttcctgcatgattttccaagatgcgccgactgaccagaaagtaccccaacgatgatccggatggaaacgggaagaaccgtcagaacggacagaagccgataagaagtatttttgattgtacgagtattcagcacttccaaagaaacttaacagcttgtattggtcactgtttccgccaaaatcacctaaagaggaagctgcgtcgggctcataaaatccatccatgatgactttgctgcggcttccgccgaaattggaagtgttatattcataatactcctgaccggccatcacacggatatcatgtacatcattgaacgtgtgttgataattaatgacattattaaaagtcatgcctgtagtgcggtagttgtatttgcttacactgccaccactgatagaacctgtgccgtaagtaggattggtgtagtcatgatttgttttgttgttatagtcaatgttcaaagacatcttgtaagcaagccctttgataggagttatttggataaaaccacgtaaagaggcagcatcacgttttatctcgcttttatcgtgtggcatggaagccagcagattatattttgcatacgagttcgggcgatactcaccataatcgaacatacggttaccattttcgtccaacaggtatgctccggttgtcaagtcgcgttgatataccggatagaaagatggtaccgaacgggcaaacatgaccacattggaaatggtagagtcatcttgcttgggatagtcttgaacagaatgagttcctgatacgttcaatccgatctgtaaccatttgcggatatctgaagtcacgttggcgcggagagtatagcgtttgaaaccagagcagatataagcaccttggtcatccatgtaacctgctgaaacaaagtacttggaggttttgctaccaccacttacgcgtacatttaaatctgtatagtgcgcatcttgtgaaagggcgtcgtcccagctgtcgtcccataatggtttggcgcctgctaccagttttccgtcatggccgattggttcagggtaagcactgccataagggttgatgcctagattacctgtaacattgcttgatgcccatgctgcagcttcttcggcagagtaaccgttgtccatacgatagttacgcatggcttcccaatataattcataatattggtttgtattcaactggtcgtagtctgcccgtgcacggcttgaaaaaccatatttggcagataattcaacggtgggtgcgctatctttatttccttgtttggtggtgatcataattacgccgtttgctgcacgtgagccatacaatgcagcggaagctgcatctttcaatacagtgattgacgcaatatctgaagatgctatggaggaaagagcaccatcgtaaggaacaccatcaaccacatagaggggattggttgaagcgtttacagaaccaactccacgaatcaggatcgtggcgtctgatccaggctgaccgctggaggaaaaagactgtaagccagctacagttccttgcagtgcttttgatacactactgacctgtgctttttcaatagtaccggcggcaatatagcttgcagaccctgtaaatgtggattttttggcagtaccgtaaggaacggttatcactacctcatctaccatttgggctgcttcctttaattctacgttaatcactttgcgtctgtttaccggtatggttattgtttcataacctacaaaagagaagatcaggctttcgttaccattaacctgaatctgatagctgccatcaatggaagtgatggtaccgcgagtttgtccttttacagctactgtgacaccaggcatctcttcgcctcctgcggtgactttaccagttactgtaatttcctgtgcatatgtaatcatgcagaatagcaagctacataataatgaagaaaatctgttcatataaacttggcttttattaggggtttgtacattgccatttttcaggcattatatattgaactctctttctaaaattgtgatgctaccttttttatcattatcatatttcctaatagtggttttatggccatccaaacctcattagggtctctttttgcttgtgtattttataattgtgatattcaataacaatcgcaaatatatgtattttgatttaaataggataatatattttaatatttttttatggtgaacctgttgaaagtcaaaactatacggaattttattaacgtagttaaaataggaattgtcttatttaaatattgggcggatagatcaaatatatttgtttatcgcattcctgtgtattgatttgtttaatttgatttcaacagtaaatctacttgaatatcaaaatgaataaaaatattttttagacatattttattgcttgttgtatgtttattcgtttgtgggctattcgtttttcagtcggaaaagtatcgtttgcagagaggagatatagtaaattaaggtaagataggaaggatttcgcctaaaatgtctatctttgcaatccaataacaaataagtgtacgtacatattatgaatatagaagaaaaactcaccacgtccattatcagcgctatcaaaacgttgtacggacaggatgtacccggaaaaatggtacaactgcaaaagactaagaaagagtttgaaggacatcttactttggttgttttcccttttctgaaaatgtctaagaaggggcctgaacagaccgcacaggaaataggcggatacctgaaagagcatgctcccgaattggtttcagcctacaatgcagtgaagggctttcttaatttgacaattgcttcggattgttggattgaacttttgaattctattcaggctgctcccgaatacggtattgaaaaggctacggaaaactctccgttggtgatgattgagtattcttctcccaatacaaacaagccgcttcatctggggcacgtccgtaacaacctgttgggaaatgccttggcaaatgtcatggcggcaaatggcaataaggtggtcaagaccaatattgtgaatgaccgtggtatccatatctgtaagtccatgctggcctggttgaaatatggtaacggtgaaacacctgaatcatcgggtaagaagggggaccatttgattggtgactattatgtagcttttgacaagcattacaaggctgaggtaaaggaactgacagttcagtatcaggctgaaggcttgaatgaagaagaagctaaggctaaggcagaggcaaactctcctctgatgctggaagctcgcgagatgctccgtaagtgggaggcgaatgaccctgagatccgtgccttgtggaagaagatgaatgactgggtatatgccggattcgatgaaacgtataagatgatgggagttagtttcgataaaatttattatgaatcgaatacctatctggaaggtaaggagaaagtgatggaaggactggaaaaaggtttcttctaccggaaagaggataactctgtatgggctgatttgactgccgaaggactggaccataagttacttcttcgcggtgacggtacttctgtttatatgacccaggatatcggtactgccaaattacgttttcaggattaccccatcaacaagatgatttatgtagtgggtaatgaacaaaactatcatttccaggtactttctatcttgctcgacaaattgggttttgaatggggcaaaggattggttcatttctcatacggtatggtagagctgcccgagggcaaaatgaaaagtcgtgaaggtacagtagtggatgcggatgatttgatggaagcaatgattgaaactgctaaggaaacttctgctgaattaggtaaattggacggcctgacccaagaagaagccgacaatattgcccgtattgttggtttgggtgctttgaaatattttatcctgaaggtggacgcacgtaagaatatgactttcaacccgaaagaatcgatagatttcaatggcaatacaggacctttcattcagtatacgtatgcccgtatccagtctgtattacgcaaagcggctgaagcaggtatcgttattcccgaaatcattccagcaggtttggaactgagcgcaaaagaagaaggtttgattcagatgctggctgattttaaatcggttgtcaagcaggcaggctcagactataatccttccattatagcaaactatgcatacgatttggtgaaagaatacaaccagttctatcatgatttcagtattctgcgtgaagaaaacgaagcgttgaaagtcttccgtctggcattgagtgccaatgtgggcaagattgtgaagacagcaatgggcttgctgggtattgaagtgcctgaacgtatgtaaatggcaaagaaacagaaatattatgtagtatggaaaggtgtcaatccgggagtttatgactcctggactgactgccagctacagataaaaggttatgatggcgcacaatacaagtcattcgagaccaaagaggaggcggaacacgccttggcttcttccgcttttcattatataggcaagaatgctgttaaaaaagaagatactcctaaacaacttcccgagaactttgatatgaactgcctggctgtggatgccgcttgcagtggaaatcccggaccgatggaatatcggggcgtttatttgcttacgggacaggaggtttttcatttcggtcctgtttatggaacgaataatattggagagtttcttgccattgtccatgccttggcattgatgaagcagaagaatatcagtatgcctgtttactcggacagccgtaatgcgttgagctgggtgaaacagaagaaatgtaaaactaaactagagcggactcctcagacggagaaactttttcaaatgatagaacgagccgaaatttggctgaaagaaaataaatataccacacctttattgaagtgggaaaccgaccgatggggagaggtcccggctgatttcggacggaaataataaagaactgaagatatgaaaaagaggattgcttatatcagcttgtacttttttacggtcttactgatatttattctacagaaaccattattcatgctctataatggttccattgaaaaaggattcgggtttgccgattatatgcaggtaatgattcatggcgccagtcttgatgccgctacggcgggatatcttactgcatttccattcttgttggtactgataagtatttggtttaggaaattccctttgaaaaaaatactttacgggtattatattttggctgccgcgcttatttctatcatttttgtggtagatatggcattatacacattctggggatttaaactggacgcatctgtttttctttatatcgattcaccgaaggaagctttggcgagtgtttccgtcggatttatcttgctgagggttcttgccatcttgttactcatagccttgaatagttgggtcttgctgaaaatcacgccttccgttttgaccgccacccggaaacggatagcgggaactgcgggaatgctgttattaggaggtgtgcttttcatcattatacgtggtggtgtaacggaatccacttctaatatagggcaagtatatttcagcaacgaacctttcttgaatcattcggcggtcaatcccgatttcagtttgttgtcttctatgggtaaatcccaggattttgcatcagagttcaatttctttgatgaagagaagcgggctgcattgtttgacggactttatcctacaacagatggggatagtattattcaagtcctgaataccaagcgtcccaatattcttattattttgatggaaggttttggaggtgcttttgtagaacctttaggcggtcttcctgatgtgacaccccattttaaccgtctgtcaaaggaaggggtcttttttacaaactgttatgccaatagtttccgtaccgaccgtggaacagtctgtactttcagcggttaccttggattgcctacggcatcggtaatgaaaattcctgccaagagccgtacgctgcctgctatagctgaaggattgtccaaggcgggttataaaacagatttcctgtatggaggtgatatcaactttaccaatatgaagagttatctgctgagtaccggttatcagcgtcttacagccaatacagatttttcattggccgaacagaccagtaatgcctggggagtgaatgatgatattacttttgaatatttatataatcagttaagaaaccggaaggaagaagggccttggcatactgcgtttctgacacttagcagtcatgaacctttcgaagttccttatcaccggctggaagataaaattcccaatgcctttgcttatacagatgaatgtctgggtaagtttattgaccggttgaagcagactcccgcatggaaagatcttttagttatctgccttcccgatcatggtttctattacccgcgtgaggggtctaatgcgatgcctcgtttttatcatattcccttgttatggttaggtggagcggtaaaacagcctatgcaggtggacaagattatgaatcagaccgatttggcagccactttgttggggcagcttgggttggaacatactgcatttacgtttagccgtaatgtattgggaagtgattataagtatccttttgccttttatagtttcaataatgggttctcattcagagacagtacaggggtgacggtgtttgataataattccggcagtattctttttgatgagcctgaagctgacgaatcccgtctggataagggtaaggcgatattgcaaaccgtttatgatgatttagggaacagatagtaaaacttggacgcggactatatgaatcagtatggaattcatatagtccgcgtcccaatcggtgcagaatctgccggatataactatttccgtttctcgttgaacttgtacatgattaccgtattgcgtaagtcgcaacttctgtaatctgtatggaagacctcttccagctgatactttgcattgtaattctttaaaaactcctcttgtgcatttgcagaaagtatgacatacccttcttgcggattttccagtgtgaaattccgcatttggttattcatataataatttgtacaataaaaccgtatcattctgtctgtatatgaataaacgactccttcaggcacctgttttctgatatcctctgccagatgcttatcggattttacagctagtattgttggctgatataccccgtctaaagcgacaaacaggcaaagaacacaaccggtgattccatagaggagtgaccccgtactactttttttgataaccagccttaatgtacagatggcagccactaccggcaatactataatcagccatttggaaatagaaaaggacgtgctttccaaagcttgcataaacgctatgttttcggcagcatgacgtccgttgccccatatgctgtccggtatcatctgacagcgtacagcaaaaaacaccgcggtgagtaacaaacagagcgaggcaaagatataagccgatattttgaacactttcgcccctttttgcattaacgcctccagatactgggcaatcagtacagccataaatggatagataggcaacaaatagacgctgcgtttgcttttaggaatacaatagaagacaaaaatagcgataatcactatccagataaacagctgtatgggggattgtgagcggatgttatcccaaaccttcctgatgcgtccggtgaaagagtttcctgcgggcagcaggtgcatttcattccatttcagtccgaagagtgagataagcaagaccaatgtccaaggtgtccacccccatataatggtcaggaagttataccataaagggttgtgatgcgacgggtatgacattttgccgacaaagcgtccggtgttttcctccagcatcaggtccataaacggctgtcctccctgtagccaggccgcataaaaccagattcccaatggaataagggaaagcagcccgattccgaataaggaaaggaaagtcttgccgaatgagcgtccccgtatcagctggtaaataccgatacacatacaggggaatatagaacccacaggtcctttggtcagcgtgccgcatgacatcagcacgacagccgtccaaggtattcccttgcagcctttttcgtcccagcgaaatagtaagcaaagtgagatgacgatgaaggaaacctgtagcatatccagcctgcaagccaccgccgcccggtgcacttcgaatgaagtgagcagtaaaagggaggtaatgactgctgtctttgtatccttatagcgggctacgaatccgaaaaacacgaactgcatagctagaaaagcgatagcggacggcagacgggacgagaattcgctcacccctccgaaaatggcggaaatagctgcaatagaccaatacaggaaaggaggtttataggcgatgtctgttccgtagttcaaaggcaatatccagttgccgctttccaacatcgagtatgccacaattgcttcgcgcggttcccctttagagtaaaaaatagtttctcccaaaaaggggattattacaagtgtgcttagtaaggctatgaaccaaaatgcttttttcttgtctgacatatatttttcggtcttttatatttactgtcgcaaaagtacgaataattctttagtaatacctaactttgcattttaaatcaatgaaaatgaataaactgaaacagatacccgagttcctgcgatttgtaatggtaggcctttttgctacagggctgcactatggcatttattttgtcttgcaaaaattcattcaggtcaatgtagcctataccttgggatatgtgctgagttttgttgccaacttttatcttacggcttattttactttcgggcagcctccttcctggaagaaagcttttggcttcgggggggcacatctgacaaattatctgatacatatcggattgttgaatctctttctgcggttgggtttttcccgtccgttggctcccatcccagtgtttctcattgccattccggtaaattttttattagtgaggtttgttttcaaacaaaagtaatatctttgaggagtctttatgatagtgaagaatgatatgaagaaagtgactcttttgattccggtatataatgaggaagcgatgctgcccactctgtatcaacgtttgatagagcttgtcaaccgcaatgccgtttatgagtgggaaatcctgtttgtcaatgatggcagcagcgacactacgctggaatgcctccgccggctgaggcagcaggacaagcgggtgaattatgtcaacctttcgcgtaactttggtaaagaggtagccatgctggcgggttttgattacgccaccggcgattgctgcgttgtgatggatgctgatttgcaggaccctccggaactggtagaccagatgctggaatattgggaagaaggatatgatgacatttatgccaaacggcgtacccgtggcgaggaaagctggttgcgtcgtcagttctctctggctttttatggtatacttcagcggatgagccgtattgatattttgcccaatgtgggcgatttcaggcttctggaccgtcgttgtgtgctcacgttgcgtcgtttgcgcgaatgcgagcgttatacaaaaggattgttttgctggataggctatcagaagaaaagcattgaatttgatcgcggagacaggctgatgggccattcctcctggaactttctcaagctgttgaatctggctgtcgaagggataacctctttctctatcgcccctttgcgcatcgccacggtatgcggagtgctctgttcaatctccagttttatttatgccatttattttctgataaagaccgtgctttatggtgatgaaacggccggcttccccactttgatcattgtcatgctctttttaggtggcatccagcttttctctttgggaattataggagagtacgtggggcgcattttcaaggagaccaaaggccgtcctacctacatagcctctgattataacgaggagaagttggggtatgaccgttaaggaaggcaaggcggtgaaacccgtcccaccttattgtccggtagctttattgacagtcttgtgctcttttaccagatactccgcactctgcaatgtggagaaacagtattttttcatcacgtagaatgtactgtcctcccctgttacaagttgcaaggcgtttccttgcttcttatatttgaattcctgccggtcatgtggagaataaatatataggtgggttgtatctgtagccgctatcaaattatcggcggagaaatagacatacgggcgttgttctgttaacaaatttatgccgaagtcgttttgggtataactcatgttcagcagtccgagtaaagtcggtgccacatcagtctggccgcccggctcttgtctgatttcgggcttgatgccttttccgtaaatcattagtggaacatggttgtaggattgtggtatttcacagtccggacttcctaccaatttcccatggtcacccagcaaaacaaagattgtattttcaaaccaaggttgtttgcgtgcttcttgcatgaattgccggatggcccagtccgcgtattccacaatctgatcttcaagctttgtgctgtgtggtttgaaatagtcaggtatcacatacgagggatggttgctgatagaaagcaatacggtaaagaaaggttgtctttcttctgctcttttgttcagaatgggcaaggcatattgatataggaaatcgtcttgtacaccaaagctgttaacgactttatcctttgggtagttttcttgtgcatatatttcatcaaatccgttagtgcggagaaaagcgttcatattatcgtattgtgattcgtgcgtcatgaagaacaggttccgatagccattatcctttaatacggtgggcaaccccgaatagacaggtaccactgctcctttcatggcattccgtttcatgatggcagggaaagagtagagggtggcatacattccgtggttggtatgtatgcccgctgaataaaaatggtcaaaactgagagattccagataaaggctgtctaggaaaggagtcagttttttggtagatccgaaatgctccatcaagttggccgacatcgattccatgaaaataagaacaacattcttttgtgtagggacggctgtgcatttcacttcacgtgcaatgggggagatgccttctattccttttctttgcaatatactttgcatattggttattgcctcctgttccggcatcaggtgaagatagcggttttccttacggttatcatccagtgtgctggtaagtagattaaagacaggattaacccctagctgattcaggaatggatcggtgcaatagtatgcttgacttaccctgatggggttatatcccatgcgtccccgtattccgaatagacaaagtcctatacaaacagcaccggcggcgaatatacataggcggtttatcgggctgatggaagtagatttcgaattgatgagatgatagaaataagaagataaccgtagtacacttcctgacagcagaagaatagatatcagtcctagaaaaatagggaaatagaatgatgtctcacccaataccattccggcagtagtggctccatatccgaaccaattgtaaatggaagaattgattgtcttaaaaaaataagagaaataagggatgttggctgccgaaataatgaacgacagtgaataaaatagaatgaaaaagatagagataaatctgaatacccacttggagtgatagttgcagagagcggttatccataaaatgactaatggtaacagcaatatgtagcaagctataacattgtcaaaccatagcccttttataaatgcagtggcttgcatgagaaagttgttttgtatatcgggaggaaactgataatctattgaggtgaacaggacaagccggaacaggaagaaaaaaagtaaagcaactatatgtatgattaataagtaaagtaaagaaagagtaaactgttggataagcttagcctgattcttacatgctgttacagattgctgcatgagtgaacggagatatttcatttgttttagtaaagtttgcatttgtttgaatcaatccggatgattgacaacaaaggtaaacagaattttagaaatatcaaaagagggtatgccaaaagtaaaattgactgccaatttgttcactttaggggcagacatgtgagtccgcccgaaaatatgggcaagcagtttccgtttcttatcctatttctcgggaaggagtaaggcggtctcttttcatagtcagaacaaaaggacagaatagccgtgctatccggttgaggcgctccagacgtccgtctttccgcgttccgtttaatttctgccggaggagttcccataattgcagttttacccggtctgttgtgcttagtttggcaatgcggttgtaaagcattccccttcgtatgcaccgtttgtatctgctcaggtgggtaaggtgttgttccataatgcgtactatctcaatatcttcgctcttaccccctccgttgttttcagctttgacggtaactttctggttatgttgtctgaagtagttcagtacttcatatctttctataatgtctccttgcattgccatataaaaccagaacagccagtcgccgctgtagcgcatttgcaggcattgttccatattttgggcatttaccatgctttttctgaaaatggccgagcttgcattggctatatagctgcgccagtaaaggttatgttcggcataagtcttcccattgaatacggcgtatggaggtatggcagatttccatttgttcatgtcgtaactcagcacattaccgtctttatcaatatacttggaaccggcaaagcatacggcggcttgttggtatttctccattaaaggaactactttctctaaaaaagtaagctcacacaagtcatcggcttcggctatccatatatattttcctttggctaattgcatgcctttaaaccattgtttaaatggatttccggtgttgtgttcgtttaatagaatatggctcactttggcatggtcttgatagtccgataatacctcttcgctaccgtctgttgaggcatcatcaagtaaaatcagttcgatattctgataggtctgttgcagaatactctgaattcgtagattgaggtatcgtttataattataattaggtaccactacactgaccaagggaagtgcattcatgctttattgttaagttagttcttgttttatttctacaaatgtaatgttatacaggtaaataaacaagttgcttctttgttttttttttcaaaaaacaggaattttgttgaacttttaaaaagaaacgataattaacattttagtatgcagtctttcttgtacctttgcattatacactacatagcatttgctgtattaaactaaaaattaaattagacattagactattgtttaaattcaattagtatgagaaagaaaattctttttattattccgtacattccttatccgctggattcgggcggtaatcaagctttctttaatatggtggaatatctgcgtcataagatggccgtatctgtattgctttatcctgaaacagggagacgtatgcaagatgtagagtcattgaagaaaatttgggataatgtggatttctttatttatactcctaaaactaaaactgtcagattacccaaaattaaacatcctttttattataaatggctgcaaaagatacatgcgtctgtaacccgtaaaatgaaccggcaacagatatggacggatgaaacgggcgaagttgtggatttagtacggggaaagagtactttgttcagctcttgtttccagccgctagaccaggggtatgtggagtatgtttctcaggtggctcattcaggttttgatattattcaagtagagttttatgaactgttgtcattgggattcttgttgcctgaaaatgtacagactatttttgtgcatcatgaactccgctacatccgtaatgaaaaggagattactttgttcagggaacagactgccggtgacaggatgttgtttcatatagcaaaggattttgagcgcagtgcattattgaaatataaagatgttattgttctgactgaagtagaccgtaaaattatggaggacttcataggacggaaagaccatatctacacttctccggctgtggtgcaagtgggtgacaggctggaacagccttttgttccggtccaaagcggacgcctgacttttgtgggaagtgaggatcattttcccaatctggatgccgtggcatggttctgtcacgaagtgattccgcatctgcgtaaacgtcatttttcgtttacattgcaagtaattggtaaatggcgtggagagtgtatcaatcgtttgcagtccgaatacccggaattgaagctggcaggctatgtggaagatctgggctcttttttaaaaggcagtgttgctgttgttccaatacgtatcggtagtggtatgcgtatgaaaatattagatgctgtattgtcaaaagttccttttgtaacgacggcaaagggtgtggaaggcattgattttaaggatggtgaagattgcttgattgttgatgaccctgccggatttgcagaagctgtcatagccttgtcaagtaatccgcagttgcagagacagttggttacccatgcggaagacagtttgcggcaagtatataaccccggacagatgcaggaaagaaggcttgccgtgtatgaacaaatattaggggataaagtggggtaatcttgggtgattatttcttttttgttacctttgcggcattatatataattgataattatgctgaaacagttctttagtttgttgaagcggtatattcttccataccgcaaatatttgacatgggcattgatactgaactttctgtcgcaatggcttaatgtgttttcgttcatggcgattgtgccaattttgaacattctgttcaaaattgataccaagtcttatgagtacattcctatggatattcataatttggataaggatgtactcataaataatgcctattactttgtgagcaattttgtggcgacaaatggtgcgttctatacacttgccatgatgggaggaatacttatctttatgactatgttgaaaactgccggttattttgcttctgcggctgtcatggtacctttgcgtacaggtattgtccgggatatccgtattcaggtttataataaagtgttaagtcttcctttgagttttttctcagaagaacgtaaaggagatatcatagcccgtatgagtgcggatgttacggtggtggagaactcgttgaccagttccatcgatatgcttatccgtaatcctatcgctcttttggtttgttttgtcactctgttttcggtaagttggcaaatgacgctttttgttatctttattttacctctgacaggttggataatgggggttgtcagccggaagctgaaaagacagtcctctacagcacaggcgcaatggggagatattatgtcccaattggatgaaacattaggaggtttaagggttatcaaagcgtttatagccgaaagcaaaatgtctgcccggttctctaaaacaaacaatgacttccgcgatgcaatgaacgagatgattatccggcaaagttcagcccaccccatgagtgagtttttaggcacttgtgtgattgtgaccgtgctgttgtttggcggtgctttaatcttaaatacaaactatgctccgatggatgcggctactttcatattttatctgattatcctttatagtatcatcaatcctttgaaagaattttcaagagcattttataatattccgcagggattggccagtatggagcgaattgatatgatattgaaagcggaaaatcatatcgtagagccggagcagcctttgccattggacgctttcacagataagttagagtttaaaaatgtaagtttcagctatgtagaagggcgtccggtcttgaaccatatcaatctgactgttcctaaaggaaaaacgattgcactggtgggtcagtccggttccggaaagtctactttagtggacttggtaccgcgttatcacgatgtatcggagggtgcattgctgattgacggcaagaatgtgaaagatgtatccatccacagtttacgttctctgattggtaatgtaaatcaggaagctattctgtttaatgacaccttctataacaatattacttttggtgtagagaatgccactatggagcaagtaatagaagctgccaagatagcgaatgcacatgatttcattatggaaacggaaaaaggatatgacacgatgattggtgatcgtggagggcgtttgtccggtggtcagcgtcagcgtgtcagtatagcccgtgcaattttgaaaaatcctcctatccttatattagatgaggctacttcggctcttgacacagagtccgagcgtttggttcaggaagcgttggagcgtttgatgaaatcgcgtactactatcgctatcgcacatagattgagtaccattaagaatgccgatgaaatttgtgtactttatgaaggcgacattgtagaaagaggaactcacgatgaactgatagccttgaatggatattacaagaagttgaacgatatgcagtctttgtaaagtggagcaaataaagaaattggcaattgttattcccgcctacaaggggcgtttccttaaggaaacgctcgactcaattgcagttcaggcccataaagatgagttcgtgttatatataggtgatgatgcaagtcctgaaagattggataagattgtggaatcttatcagaataaggtaaatctggtgtatcatcgctttagcgaaaatatggggggcaaagatttggtggcccattgggagaggtgtatccagctgtctgcagagccgtttatctggcttttctcggatgatgatttgatgccggctgatggtgtggaacgtgtcatggaggctttgtcgcgcccacaccatcagcgaggatatttctttcgttttccattagctgtcattgatggtgaaaacaagcggatacgtgccaatcgtcctttggaagaaggaagtgtgtcttgttaccggctgctgctagataagttacagggaaagatagattcggctgccgtagagtacgtgttcagtcgggagatatggcagtcggcaggtggttttgttcattttcctatggcttggtgttcggatgatgctacgtgggctgcttttgcccgtcatgcggggggtgttatttctttgccggggcagcctgtatgttggaggaatgttgaaggtgcaaacatcagtaactctgccggtcatgacaaagataaattgcacgctactattcttttcttgagatggatgaggaatatgttttccgattatgtggatgatccggagctgattagtgcattgcaatgctatatccataccatccttcgtatttcattgcataaacattataatatatgtggtttgtggggggtatctatggctttgggaagatttaataaaagggcggcctttactacgtttttcaggaattttaggttgttctcttaatttcatttatgcagccgcttgcgatttctcaagagtgcctgtattttcataaaaagtttgggtgcatatatgctctcacttcatatttctgtcctgtatgtatagtcagatgtatatcttcctgtcatatattgtttcacttttttaaagaaggacattggggagttttttcatccgtaaggaattgtgtggttttaaaatcagattcatccttaaaatatcttatccgcatccctaaacatttcttgctgtatggttaagggttttcttcctgtttgttctatctccgcaagcctttggagttaactccatagtcttgggagataactccaaagcttatggagataactccaaaggctatggagatagaatagatgcatataaaaaggtttaatctggagatagaaaaagcttatgcaatagggctgactgctatacacatccattcattcccttatttattggaagaatttatagatagcctgtattattgattgtcttattttgaaggaaagataatgaattcttttaaacgttttgatctttttcaccgttgccatgccttcgttatccgtcattctgtgaaagtacacactctttattgcacttttgcaaggaaaaagtctgaaaatgccatactttatatcaagtcggagcagcttacaggaaagaatatataactgacagtaagtaggttatgagaaattctgttttaaaatgtagtgagggcatgagggtataagtgagagcaattttttttatcatcactacataaatatcttataattaacttgttatatatgtagtgagggcatgagggtataaatgttccgaactttctagtgagctgatatattaagaatactttcggatgttatccaaagaataaaatgatactttaagaacaaaggttctccccttgatttttcaggtgaatcctaaaggaagccaggattttttgaaggggggggataatgttaagacggtatgaaattttattttggatagcgctgattatcttgtaattgcatataagagagcatggaattattagaattttgatttggtatgataaaaataaaagtattattcattgatcacttccatccatttctttatgataatttcgatggaaaattgcttgctactttcaatagcgttggcagacattgatttacgtagcttttcatctgtcatcaatagcttcatctgtttaatatatagtgatatatcatcattggggatagcaaacccattgactttatctgttattatgtctgtcaatgaagcaaaactatgaaaagctaaaggaacgcaaccatattgttgtgcctcggttaatgtcagcccccatccttcaaaagatgaggtcatcataaaaatagaagcttcattataataaggttccggattttttgtcccttcaaaaaagacacgttgtaagccataatgtatgactagacttttgtaccagctttccattttcccatgtcctactatttttagcttccattcggatagagtatggtctgtttcaatttccttccaaatctttaaagccagagaaattcttttaggttcttcttccagtctggatacaataagtacttctttctttttgtgattatagttggctaaatcatagaaagagtggaatgaaagagcattatggattattcttattttactatcatcttttaaatgagagtattctagaaacggctttttgaaatgagaagataataagataaccttatcggcaaaatgatatgactctctatataaaataggtagttttattatttttcttatcttttgatatggaaaggataaaaatttgctgatgtttttcctaatgttctttccttcttttagttcttttttaggattatctaaggtgatgaaattaatttccgtggcaggacttacgtggagtgcaaacattagcttgcattttttgttttgagactggtttaaagcaagtcttaaactcttagttaacttatgctctccttgattaataatgacgtcaattttattttgttctataaattggattaaattattgagattgtgataagaattgattttaattgtattaacgaattgctgtttaataaaggatttgtcaatgttgtatttataggcagagtaacagttcacattataaaaagtagttaatgcatttgcaatattagcagtaactctttcaacacctccgtattgtggcgcaacttcattggtagtataaaatagtatattcatttgggaacttgttttaaatataatttttgaatcttgtagacaactcccatctggtttgaattgaatttccgtgcaaatattttattagagttaataagcgtctgataatcatggtcttgccatatataggggctgccatgctcccagtcaatttcccgcatactaccggtattggcattgttcgtacaatgcattctttctcgaaaaggagagttccataaaatagtttgaatgaatatttcatctgcgcaaagtgtatatttcatacgatttaatacaatctctttgtattgtaatagatacttgactgcgttttcggtaatacttatccaatttcctccttttttgaattcaaaagtttgttttctgcgataatggcttattttctgtactgctaatatgaggtttcggattaatgctgtaattccatgtaacagatgttccttatcttttaacctttttgtaaaaaaatagtatcggaatactttgcgctccaaatcacgctgatgagcggcatcctgccaaaagcctacaaattctttaccggcattctgctggaaaaaagcatgaatgtaatcttggctttttatgggcaaatccgttccggataataaatgataataagcatagggaccgtgtgataaggccgtttcaaagagaagatattctacttgtacttggctgatatcaccccaatatactttgatgggattttctattaaataaaagccggctttctgcattttgactttttttatttgctgaaacagttctgtagcccgtttgtcaatatgcaaataaatgtcattacgttcatcgtccaacatggaaagtagtacctccagtaccggatattcattgtgggcgataatcagaaatgcatgtttcattatatatcaggttttaatcttttaaagaaattaggaatcgttacatccggaataatgaatccgtctttgcgaagtgcttcaaaataagcactgccgataacacgttcatattcagcctctagttttccttctttatgtaactgatagaagtagcgccagtggcgacctccgtgtctgcccttgtgttgctccagttgcttgccgccatttatcatcttttccataaactgctgcttgccgcgtatattgtaatgatatacatggatatggctgtcggcagagttttgtgggaacatggttactttatggtttcccattgaaatttgcaggtaaccggcagtccggtgaatgacttttttgttctgacgctcaaacagcgaatagagtgacaagtcatatttttcaggttcggttaccgcttttacagtcttatcccattgccaaaagggtttttcttcttcaggatagacacttctcatttcacaatttagcacattggcattggtggcatataattcatctttcaaattgccggtaggggcataccataattcgtcggcatcggcattgataatccagtcggccttataaatggttttggctttccaaatcatacggtctacccagtccttttgttcatagttggtagccttttcttctatcacttctttaatccaccctttttgtttgtatttacggataatgtccggagttgagtctgtggagttattatcagtaatgataaacccgtccactcccatcgctttatggaactgtagattctcttccagcatcccttcttcgttttttaccagcaatgtcatgaataatttgacttctttcgtttgtttaaaagccaaaggaaattcggatataacgtgccctattttggatagtaataaattgctcataaataaccaatgattattgatttctacctgtcatattagagataattaatactattgtcaaaagaatttgttttattctgaactcattataatagataacgtaatccttagttttctcataatattctgatatttaattatataacaaatttactctttttctgtaaatatagtatataaatgctagtttattatgaaacattaactggtaagggcgttaccgttttttagctcataattccaagtttttcatgtattccgtcgcaataggctttccataatcggggtatatctttccattgataggcttttgcaaacggactggtgaacaacgcgatgaaaatatatcccattactccgttgaagccgcgaagatatttcactgctatgttgcgtccgtagtgatggtttaaataagttgaattacggatctggtaaaagcgtttccactttttcttcttgcttcgctcattccatgtgtcgttggagaagaatttctctttatccatcagggcatcaggtatatagagtattttgtaccctgcccgtatggtgcggaggcagtaatctgtatcatcacagaaaatgaaaaggcctttattgggaagacctatcttctcaacgacttcgcggcggatgaacggaccttcgaaagctgttcccgtaatttctgtcggtgaggtgatgtgccgtcctgccagtttcttgctgtacatggatacaaaaggattgctcaggttgtatgcctggaagtcatgggtgaatatttctccttcgagcaacctgcgaggggccagtatgccgatatctttcttgccggtatacggcaagagttgttccagacagtcggcccgcggaaatacatcgtcatccatgcaccaaatccagtcggcacccgcctgataagcgtattgtatgcctgtatagaatcctcccgcaccgcccacattggtctgattgattactgtcagcccttcctgtgcggcaagccattccgttgtaccgtccgtgcttccgttatttactattacaatggaagatatcggcttgttttgttgcagacaacgaatatttcttttcagaagttccattcggttgtaggttacaactacggctataatgttcatgatgcatttagtttttagtaaaggttatctatttttcccggctgtacgcttctataggctctcatgagctcaaagcatttttccacatcaaagttccgtgccttggcatattcttctgccatccatcggtgcatttgtggagttgccggcaggcgttcaaagtttttgcagccggtcttcatatctatggggccgatgtacatccggttcaaatcgacaatttctattgttatgccattgggagttttctgaaacaggatgttggcacgtccgtagtctttgtgggcgtatccgtgttcgtgaagacgggcggtcactttgcctatggcgcggaatacttcctcggcgtagtcgaattgctgtgtgaacaggttgtcgtaaatgtaggggcaggtggagaggaggctgatataataacttttatcgaacagcagccctgaacgtatattcatatatcccaccggttgcggagtgcctacacctattttcagcagcatttctgcatggtcgtaagagcgttttgccttggatggacgaaatatgccatatacaaatcggttgataaggtgggggctgtgaaaggatttgataacatattctttgccattgtattccattttccgcaattcattgcgcccttggtgaataacagtaccttcattcctttggaaacgttcgggaatggatactataaattcttccagatttttgaaatcagggtgaatcactaaggtgcggggatgaaacaaacgctctgtcttgctcatatcattataatagtgttaaattttgtctagtcctttggtatatttcaaccagtaatactttaaaggattcttgtatttcagttgtttccacggacggctgctatggggcctgtgccatacgggcaacgtggtgaacaggtagttttggaaacctcgtttcagtgactcgtgcgagatggtcacatcataccagttcttgcttgggtctaatgtttgaaagtcaaatgctttcagcagtccgggggtgagtagtgaacagcagaagctgcaatgctttttttccgggtacacttgattctcgtgtcccttggcgtgtaggtaggggtaattgattacgcctttttcatcggttgtcacagctgctgcaattccgcattgtttctgttgcaatgctccattgtatagtgattgcaatgtgttttttttgacaataacatccgattccacaatcagtaatcctgcatctgcttcgatggcttctttttgtgctgtttgtaacaccagtagatagttgggagaggggtggtcggtcaggtctgataagttgaccagacgaaaattccattgacgggcggcctcttccagccgatgggtattttcttccgtgctgaaatcgttatagacagtataagtgaaaggaaccaaaatatccgattccatgattgcttttacggtttcaagcgtggagtcaatcgaatcttttacgggtgttatgatatgaaggcacttcattggtttgttatctatgttgtttgtcaatttaggaatatcatgcaaatttagcggaaaaccttggggagtccaaggatttccttttatttaaatgtctttttgcataaggcgagggcggcggctacggtatcgtccatgtcggcgtatgcgtattgtgccagacggcctccgaataaaacgtctttccgctcagaggccagttttttatattggctcatcatttcggtgttccgcttgtcgtttatcggatagtaaggttctttgcccggcgcgaaatcatcgggatattcatacgtgattacagtggtgggctgtgtgccgaattcaaagtgcttgtgctcaatgattcgggtatagggtacctcacgttctgtataattgactactgcgttgccttggaaatcctctgtttccagctgtttatgttcaaagcgcaggcttctgtattccagatgtccgcattggtaatcgaagaactggtctatgcatccggtgaacaggatattgtctgccaatgcgtccagttcattgcggttgctgaaataattggtgttgagacgaacctcggttccttccagtaacgcatcgataagggcgttgtatccgcctttggggattccttggtagctgtcattgaaatagttgttgtcataaatgaaacggaaaggaatacgtttgatgatgaatgccggtaattctttggcggaacgtccccattgtttctctgtataacctttgataaggcgatggtaaatgtcttttccacatagctttaatgcttgctcctccaggttggcgggggtggcgatatggtcaaattctttacgttgctcttctatcttggccttggcttccgccggagtctttactccccacagctgataaaaagtgttcatgttgaagggaagattgtataatttcccgtcaaagtaagccaaaggggagttggtgtatcggttgaattcgacaaagctgtttacatagtcccacacttctttattgtcggtatggaagatatgtgcaccatatttatgtacatggatgccctctatatcttcacagtagatattgcctccgcgatgattgcgcttgtcaattaccaggcaatgtttacctactcgttttgcctcgtgggcaaaaacggcgccgaacaaaccggcacctactatcaaataatcatatttttccataatcacttagtttcttcctgttgtctgcgcagccactcttctttggttcttttccagcggttatggctccagagccaatattggggatgcgcttttattgtttgttccaattctcgggtaaacaaatcggtcaattcaaaatcgggtacttgccggggggtgtcgcacaatggtttgagccggcagtggtagtatcctcttttgacccgtgttacgtcagcataataaatcaaggcgtccacttgtttgcctattttctccgtaccgatgaaaaccggtgtttcttggtttagaaattcagtccagtgatgtatgctgttccacttgggtgcttggtccgaaataaatccgataattgccttttgctttgtccgtttcaattcaatgatgcggcgcaaagtcgttttcatggggatgcattcgcctccgaactggttgcgtaatcttagaaatagtttgtcgaaagcctgattgtacagtggatgatagatttgtccgcaggatatgtctttggaaatccaataaggcaaggatgcaatccattcccagttgcaataatgccctaaatagataaaacagaagtctttgttctttttgttcatgctttccactatctcgtccagtccttcaaaagtcattcttctcatcagttgtttttttgaaatggagaataacttgagcgtttctactatatagtcgcaaaagaaagagtaaaattgtttctcgatttggacaatctcttttaaatctttctcggggaatgagttcgataaattattgcgtatgattttacgtctgtagcggatgcaataatagagcggataaaaaagaagatcggatatgaaatataagaatcgcaagggtagaagcgaaagcaaataccacaaaaagaaaacggaataatatatgagatttatttgtttcatttaactgatgactttgtttatgtgttctattaccatttcgggagttatgccttgcagacaggcataatcttttctataacagtgcttttctccggataaggaacaaggacggcagggcaggtctatctgtattgtgtttgccgcagactgattccatcctgcaaagcctgcacagggatgcgttgccccccaaatggatacaaccgggatgttcactaatgatgcaaggtgcatattggcggcatccattaccagcatgacgtccatattgctcatgagggccaattccatatttatggttagtttgccggctgttgagatgacattggggaaatgttgggcccattcttccaatactttgatttcttttttcccgcctccgaataagaagatttttgtatggtcgcgtgcagatagatgtttgaggatctgctcttgctttgacaacggatagattttgcctacatgtgttgcaaagggagcgattccaatccatgtttcttggttcttctcaccggttaacggagccaggctggaaatattgcctttattctttccgaaaagggagaggaaacttaaccggatggggtaacctatctgactgagcgtatgggcacagcgctgaaaaaaggagtcttgctctgtatatattttatgtttccgccgtatcagtttttgcagttcccgcctgttctgcttgatgtgggctgcttttatgcctgccagacgaaaacgccagcaaagaaaacggctgcggaatgtgggctggaaagcggctacggcatcaaatttttcttcttttaaatcattgtacagccatcccagacccattaatccggcatgttctcctctgaaatctgccccacggaaaataacattgtccggcacattctcgaataagggggagaatgtgtctatgctcagcaccatgatttgatgctgggcatattgcgtagccaatgagtgaatgaccgggattgccattgccacattattgatggatgaaaagcagattacaagaatcttggacataacagctgttttattgaatgtacaaatctatgcaaagttttctaatcagccaattattattcggtaaaagtgtctacctttgttcccaagcaagtttttgaaagatgaaaataattgtagataataaaataccttatatacatgaagctgtcgaacagatagccgatgaagtggtgtatttgcccggcagtggttttaccgtcggggatgtacgggatgctgacgcattggtgatccgtacccgtacccgttgtaaccgtgaactgctggaaggaagcaaggtgaaattcattgctactgcgaccatcggttttgatcatattgatgtggactattgtgatgaggcgggaattgtatggaaaaattgtcccggttgtaatgccggcagtgtggagcagtacctgcattcggtattattattgttgaaacgccggaagggggtgagattggaagaaagctgtctggggattgttggggtaggacatgtgggaagccgtatccaacgtatggcggaggcattggggatgcgggtcttgctgaatgatcctccacgtgcggaccggggggaaacggaatttgtggatttgtctgtactggcacgggaatgtgatataataacctttcatactccgctgaacaggaatgggaaatataaaacgttccatctggcggatgcggatttctttgccggtttgcaacggaaaccttttattgtgaatacttctcgtggagaagtaatagagacattggctttgcttgatgcgctgaagacaggccggatacgtgatgcggttattgatacgtgggaaaatgaaccggatattcacccggatttgttgcagaaagtttttttgggaacccctcatatagcagggtattcagctgacggaaagtcgaatgctacacggatggcattggaggagctttgtaacttcttccatatacaggctgattttaaaatagtaccgcccgctttgccgtatatggattattcttctgatccggaagaggcttttctacaggtgtatgatccgactcgtgacagtgatgcattgaaacggcatcccgaagaatttgaacatttgcgggggaattatccattgaggcgtgaaatttcctttttaccgtagggggacatttcaatgtacccccacggtggccagaacttttagtctgcttttgctgtttgcatctcttctgctacaatctgttcgcaatcttcaatgctgtatcccgatgcgggttcgctccaataccataaggcgggagcttgttgtaatgtatccataatcaattattttttagataggttattcaatgttatagttgtttccgaatgttggttgccgcccagaatacctgttcctccctccacattgctgtaaacccgtagaggttcggctagtccaatgttacccaagcctccttctaacgtgcttccggcaattttttgtaaggacaacaggtataaaaagtaggattcggaaagggaatagatggaaatgattctttgttctgtttcgtctaactctgccgttgtctcttttatttgtaaagtataggtttgtccgttaatgctttggtcggtaaagagggctcctcctcttttttccaatccgttgaatgccatactttcgtccaatatggcatcctgttccttgaatacaggatctatataatctatttctgtttcgtagtaaccgtaatagcccgtttttatttgtgtgattttggccagataataattgttcttttccggaaattcatcaaacgtgacttcatagtatatttcaaaatagtcggaaattgttccttgataaactccgttaccttttttaattgtatgactggcgttttttataggtactttctttggtatgatatcttctgccgttaccgtaccatattcgggggtggatgcaacaatttttatccggtctccttctgccgggattgtatttgaaaggaataaggtatccggctggtctgggttccggggattattcagtgttttccattgcatggtttctatgtattgattgttgatatagagctccacatgggcgtgagggagattgacataaggcttcttgtctggatagaaccaggtccgggtgatggaggccattaccactgtgtcgggggatactacactgtttattaccattttgggcgtagtgcgatattcgtccaaatctatttttcgataacaggaggtaaggaacactcctagaagtaatgtatatagcagatgtttcataatcatttaaaatttataagtgtaagaaactgatggtataatgggaactatgcccagggtatagaagcagtcgttattataccaccatcctttgcgtatgctgacgggtgccatgtaggaatagacattgtagatgctgatattccatattcccatccggttttttttctttggccggtaaatattgatgcccaagtcgagtctgtgataggcgggaagttggaaattattacgttctgtataatagtctaatccgcctggatctatataaggaggaaccaggctgcctcccggaaacggatgttggggagaaacggcctggtagttttcgaaagaaaccgtgagccggttaccggttgcgtaggtccagcttccggtcaactccagtttgggcttgattttccaattggctattatattgaatttatgccggttgtcgaatttggcaggaaaacgcttgcctttatttatctcagtgaactgtctgtcattccagcttagagtatagcctgcccatccggttattttccctttttctttgcgggcaataagttctacgccgtaagaacgtccttttccttgagtcagtttgtcttcccagctggtggaaggagggagaaactggtagttgtctttatagtccatcagatgtttcatccatttataatatccttctatggagaaagagtagattttgttgccggtggtgtaataagctcctacagccagttggtcgctctgcatcggtttcagcttgcggctgaccggtatccatgtgtctgtgggcaggttgatgtagctttcattgacttgatgtacatattggctcatccgggtataagaggctttgaggctgagttgcggattgatcaggaaacgactggaaaaacggggttccagggaagtgtacgttttcccgtcaatggtgtatagtccgaggtgaaccccagcgttcaaacgtattcttttgttcattttccagtcttcttccatatatatgcctaattcatgtgcaggcagggcagtgtcgttgttttgtctggtctgggtggtcatgccattggaaaaatgcgatttttcgtctacgggatgaaaacggtggtaaatataatgagtgccgaaatgcaactggtgggaagcattggggcggaaatcgaaattggctcgtatgctgaggtcgtcaatgcggttccgggttgaactttcctgtgatacgtagttggcttctgttccttggtagtagtctcctttcaaggtggaagaatagtgggtaaaggcggcattcacattaccgaagagttggttgttgaatacgtatgaccagccggtaaatgccatgatgtttccccatcgcagtctgccggtgtttctgctttcatatccgttgtcaccttctcttttttctcctcctttcaaaaaatcgtttccccagtaaagaccggcatatccgcggctgcggtcattgaactggtggttgagtttaaagttcatgtcggtaaaagcgtatcgtgccactatttgggtttctcctttatttctggtagcgttccagatggcgatggttggggccgaaagcgcgtcaatccatgaacggcgtaatgcaaagttgaatgaggtccggtctttgaccaacggaccttccagattcaggctgcctgaggtcagtcccagcatggcgcttccgtgatattctttcatgttgccatcctttgtatggatatcgactacgctggacagtcttcctccgtaacgggcggggaaggcggacttaaagaattctacatcctttacggcttcggcgttgaaggaggaaaacagaccgcccacatggttgatctggtataacggattcccttctatcatataaagattgtcgtctccattaccaccccgcacatacattcctgccaatccggctgtgcctgccgatacacccggcaaggtctgtagggtttttataatatcagcttctccgaataataccggggtttgttggatcaggtctttgttgagacgggtatgtcccatatcggatgtttggactaatggagaagaggtatattctccggtcactaccacttcggctaattgctggtggctgttcagcagaaccggaagcagcgtgtcttgttccaattgtgtgaatgaacggtggaaactgtcataacctacataggagatgttcaggtatacatcgtttccggcttccagagtcagactgaaaaagccgtcggcgttgctggttgttccttgatggcttttggcatcatagatggaggcgcctataagggactctgaggaggatttgtctcgtatgaagccgctgattacaatgtttttctgttttttcttgaggatgatgtatttgcctgattgtatatattctacgggcagtttttgaaacagaatgcgcaaacagtgggataacggctgggcggttattgttatatctatcggtaacagatgttttgttaaggaggactcatacgaaaaggttacacctgtctgccgggtgatttctgccaaaactttacggatgggggtttgtttcatatctaatgttacgaggggctcatcatgttctgttccttttgcctcaatacaaatgtgcatgaggcaaaggagcagaagaaaagaaaatttagaatggaattgcatcattgggttatgtctagtttcgtatctagtgtttggtttatgatttcaattatgtcttctatcggagtattgtcaaaggtcgtggtcagatagtactctttttgtggaattccgccgatatggaccttatagacttcttctaattcttttactacctttttcaagggggcttcattataaacaaacacgtgggtcttccatgcaaaagtgttggggtcactttgtttgtttatttgcatttgtcctttttggttaatgaaggcatacatgccttttgtcaggatagcctctttttgttctttgttataaaaacggacttttccagactctacggttgccgaagtctgatttgcatttgccgttacttggaattgtgtacctagtacttgtatgtttgccagttcggtctgtaccctgaaaggacattgttcttgatgtgtgactgaaaaatatgcttttccatttaaagtgacgttcctgttttttttgccgtatgccaagcggtcatactgtaaggccgaattctctgccagcgtaatatggctgttatccggaagcgtgacttctttgacagcgtgtgcggatgaggcaatgacaatccagtcttgcctgtcgtatatccaccaccaactgaatccggctatcaggaaagtgacagcagcgatagttatcagtctatataataagatagagttatttctttgtttgccgatacctagtttttgccaggcttgtgttgtgtccagcctgttttcccgatagaaccgggctacaaaacgaatatctttctcttctttctccatgcgatcttctttctttttattgttaagacagggaaaagacaaaatccccctattcgcttgccgatttttttatccgaagaaaaaagtatatattttaatggctgtttctcgtaatgttttcagtgccttactgatttgatgttcgacagtttttatagaaatacccagttcggtggcaatttcctgataagtaaggccgtcacgtttggaaagcagaaagatctttttccgttcggtaggaaggtggtcgatggctgtccataaacgcgcgtcacgttctgaccggatgatgcgttcttcttctgttaaatcttccaagtctgtcagttcggttgtttcacagtgtgtttgtcggttggttatcagtgtgagtgagcggttacgtacagtttggtacatataagctttcaggttttgaatagatgtgcctccgacaagcttctcccatacatcagagaaggcttgttggacgatgtcttctgcgtcatccagattttcagtatagcgcagggcatacatattcagcggacggtaaagacagcgaaattggtattcaaattccttgggtgataattgcatcctgtgttttattcttttttggaaggcaaacttacggcttttcttttatttgccaagcaacaagagatgaaaaagtctttaatttcatttagtaatgataacaattcgggtgcgggaggttattgtatcggcttttcggaggtagtcataaaatagggcaaacctcacggtctgccctatccgaaactttaatatggaatacctattgaaacaaaaatcacagtctttaccttaaaatattgcctttaaaagtttcctttatcagcattatcccaccaaagatgtgtaccgcctttgtcgccggaaataccgaatttgctggaattttcttcgtccagaagcttgattccgccttctactcccttagcgttggcatcataagcctggctgctataaattacgcggcgcacaccttcttctgtgtttacggctccattactttcattgacgaatgcagggaagaagcgtggatagccggtgcggcgttgttctgcccagccttcggtggatagagggaatagggcgagccatttttgggtgatgattctttccagcttttcttcgttgcttgcgctctcatcccattttacacttaatttatttacagccggagtgcttaattcggctttgatgggatctgtatagtctatttgggtgcttgttccgttgatgtaggcatctactgctccttccggatattctttgattccggcataagccccccgataagctaattcattagtcatggaaacacggattccattttcatataggttctttacactttcactgccaatatcccatcttaattttgcttcagccagtaggaaataggcttccgctgctttcatgatgggcagtggcatggaataagaggaaccgttgtttccttgaatccaaccggagaagttaccccaactgtttggtttggcaggcaggccactggcaaaacggatacccaggtattgactattggcagctactgtggtagtaccggcttcgtttttgatatctccggtattcagggtcatatataacggttggcgcggatctttggttccactcataatagttaccagattggcattgaacccacaatcaccccaattgaacatcagccacatttcattctcaagacttttatcgatcagaatatccttgttgactgttgccaaggtgttttgagcagcttcggtagcgattgccttaaggttcattccggcgttgccggcttcggtttcccgtttggacaggcgtaacgccatgcgtagtttcatcgtattggctatttttacccataggtctttgtcgccgttgcaccaacagtcaaaggatttcaatttggctatttcatctgctcccatggcactgatgtcagtaatggctgtactcagatcttcaagcatggctttatacaggtctttctggctgtcgaactcgaaatacacttcgttttctcccgataggatggagctgtaaggtatcggtccgtaggcatctgtggtcatcaatgttccgtaagcctgtacgatacgcatcacgcctgacaggcctctttcaccactggcgtcacattgtgcgatgatgcggcgggtgttattgaaaatatggagataatagttttcgtacataccaccgctatgtccccggttctctcccatatcaccattggtgaagttaccgttgggagtcataaaataacctccataaaggtcaatagtcaggttggtccaaaactggaacatattttgctgaggaggataacagtaggtcatcggttcggtacattgtgcggcaaaaggaaggtctgccggatctacctgtatgttactggtattcaatttctcgaagtcgtctgtacaggaagaaaagatgtttcctgtagtcatggggattgccattaagaaggcgtatgttaatatcttattccgtttcatagtttcaagcattagaagttaagttttaaattaagaccaaagctgcgtgaggtaggcagtgcaaacatatctacaccttgtattccattacctgtacctgccgatacatccggatccatcggggcgtctttatggaagaaaaacaggttgcggccgatgatggctgctgtcaggttcttgcctgcacccagcaagttacggaaggtataaccgaaagtcacttcacgaagacgaatattggtagcatcataaacatagttttccacagcgtatggactgttgaagttgttgttaccggtggtacgatagtacttgtcggcatcaaattttactccgtccactgtaataccgccggcatcacgggcttcacctgaacgtttcgatacgccccatccgtccaaggcggcttcggtcatactaatcacttttccaccgaatttagcatcaatcaggaacgatagtgagaagtctttgtagcggaatgtgtttgtccatcccatatttactttggcattcatattgcctgcgtattccagttcgtccatagaatcaccacttacgataggctctcctttttcgttttgcaagggtttgccgttttcatcacgcatcagatgacgtacatacagatctccgtagtggccgccttctttcaatataacttttgcacctccgaaatcggtcaatgtcagtccgttgggaaggtcatctaccaattctttgattttattatcattataagagaagttcaggttggtactccagctgaagttgtcagtgaactgctcgtaccatccgatattgaattcaaagcctttgttttctacattaccggcgtttacataacggtttctcaagcctgattcgtaaggagccgcaacggagaagaactgatttttggtgttggttttataataagtcaggttgatattcagtcggttctgtaagaatgtaccgtcaaaaccaatttctaaagaatgggttttttccggcttcaatgttctgaacggagctttgtcggggggagtgatggcaccttgagaacctagagaatagagcagattactcatgaatacaggtacgtcattacctacgatagaatagcttgcacggaatttgaacaaatcaatgttcttacccatatctacaaatttgttcagcaggacactacctccaaaagagggataaaagaatgaacagctttctgtgaaagccaatgccgaagaccagtcattacgtgctgatatatcaaggaatatgccttcacggtaaccgagttgtgcggtggcgaatactgagttcagccgtttttgggtcatccagttgtcatctttgcccacggtggacatattgccataatagttgttcggagtaaagatgttcggataaaaaatgtttccggaaccgggctgtgagaactgggaaccctcgccccataggtctacatgagaggttttggtttttgtaaaactggaacctgcggtagcggatagagaaaaatcattgaatgtatggttgtagcttactaaaacatcgccataaagttggtcgctgaaatagcggttgtctttcatgcgtcccatcggataaaggtttcctacgctggatgcgtaagcattgtgtacccagtgttcttctcctctttcgtaacgcatacgtccttggatattcagatccggagtaatgttccatttgatgcttccgccgaattcatagcggttacggtcggtgataggggtctgtctgttcaacatccaatatggattaccgaattgctgttgttgtgtatttgtccagttttggacatagcagcctcttgcgggatcatatacctcgaagttctctttatagccattccagtcttctcctctagggaagagataaacaccggtcagcggattccataagtaaccggcagctgcctgattggtgatgtgctggttggtaaacttggccgtgaaatcaatatgaatgtctttcagaatattgaaacctacttttgaattcaaattgtggcttcggtagtcattctggggagtgatgccttgtgaatagacattggcataggaaaaataagattggatattttcattgcctccgcttaaggagatggagttattcgttgtaaatccggtacggaagaatttttttgcatagtttggagctttgctgcttagtttctcaccccagctgaaagtaccgttgtcgctcattccataagtagtctggaattcgggtagcaccattgggctctccatcgtggtgttgctggatacattaacggaaactttacccgactgtgctgatttggtggtaatcataatggcgccattggctgctaccgcaccataaagcgctgctgccgatgcacctttcagcaaagtgatttgggcgatgtcgtccggattgattgtagacatggcgtcaccaccgtctcgctggcctccgtagttgctgtctacttgtgagttggtgatattcatcatgacaggaactccgtctactactactaacggttggttgttaccgctgatggacttattgccacggaacagaatcttggaagaaccgccggctccggttgagttcggtgtgatcatcataccggcacttttaccttgcagggagttaatcatattgacgctcttgatgtcattaacgtctttacctcctactgtttgcgcagaataggtcagtgtttcggattggcgtttaatacccattgccgttactacgacttcacccagtgtttctgtatccgatgccatttttacgttgattactgtacgtccgtttacaggttcctctatggttttcatacttaaataggagaataccagaatgtctttgtcactggcttgcagggtatactttccgtcgaggtcggtcactgttccgatagttgtacctttaattaatacgtttgcgccgatcagaggttcgttagcgtctttatctattacagtaccgctgactgtatgcgtttgtgcatacaatgctgttacaaacactcccaataggaatgtcaggaaaaaagtaaaaattcgtctcataaggttagattttgaggttcgttctttattagatttttgttttcagattaaataataggtttgttgataattgggcatgtttacccaataggtttgatttgatagtttttcgcataggcattcagtttaaggttaacttatcaaggtttatttattaaggtttctgttaatctctctttaagtcggtcaacattattaatacaaatatcataaccgggttactaaacaaaaacttatattttttgtattttatctcattcttgttttcttattttgaaataaatacttatgtttgtgtaaccttaaattaaaaatgacctatgaaccttaatgataaccgcttaattattaaaaccttgaagtcgggagatcaaaaagtattttccctggtttatgcttcttattacaagccgctatgtttgttttgttcctcgtatgtttctcttgaagaggctgaagagatagtgcaggatttgatgatgtatgtgtgggaaaaacgtgagttgctggtagaggacttgtcgctgaaatctttcttatttaccagtgtcaggaacagggcattgaattcaatcacccgttcccatattacccgtcaggtatatgaagaatatcagagccaacagttgaaatctctgccggcattggattcttgttatggcacggagttgtttaatgcctatatggaagcccttcattctcttcctaaagaactgcaaagagtatatgttatgagtcggtataaacaactgacccataaagaaattgctgacaagctggaggtgtcggtgcagactgtcaattatcggataggcaaagctcttcagttttttcgtattagattgaaagatttttgcctagaatagtcgcttcaatcacccgagggaaatattcgtattccaactggtgcacccgtattgccaatgtatctggcgtgtcagtgggcaataccggacaggtggcttggaaaatggtatttccttcatcatatcgttcatttatataatggatggtgatgccgctttccttttcatgggaagctatgacagcttggtgcacgcgggaaccgtacatacctttaccaccgaacttgggaaggagggccggatgaatatttactattttattcggataatcatgcaaaatggcatcaggtactttcaagaggaagcctgccagtacaataaagtcaatatgatattggtgcagtatttccagtgctttcccgtcggcaaagtcttgggctgtgaggataagtgacggaacactcagtctttcagctcgcttgagtacaccggcctgtgctttgttgacgataaccaatgctacttcagctgttcttttctctaaaaaataccgaataattctttcagcattcgtgccttctcctgaagctaaaattgcgattttcttcatgatgttctctattttggtgcacataaaacaaaaaaatgtgcaaaattctgcatttatttgcctgaatatttgctcagcccaagaaatatttattcctttgcaaccgcaaagaaaataaaataattcaatttattaactaaaaaattaaagttatgtctgaaattgcatcaagagtaaaagctattatcgttgataaattaggtgtagaagaatcagaagttacaacagaagcaagcttcactaacgatctgggcgcagattcactggatactgtagagctgattatggaattcgaaaaagaattcggtatttctattcctgatgatcaggctgagaaaattggtacagtaggtgacgccgtttcttatatcgaagctaacgctaagtaattatccttattttataatatggaattaaaaagagtagtagtaacaggtcttggtgctcttactcctgtaggtaacaatgttgcagaaacatgggaaaacctggtgaagggggtaagcggggcaggacctattactcatttcgatgcgtctaaattcaagactcattttgcatgcgaagtgaagaatttcaatggaactgattacattgaccgtaaagaacttcgcaaaatggatctgtatacacagtatgccattgcagctgctaaagaagcggtggaggattctggaatggacctcgaaaaagaagatttgaatagaataggtgtaatttacggtgtaggtatcggaggtattcatacttttgaagaggaagtagctaattatacactgaataaagatactgtcggaccgaaattcaacccattcttcatccccaaaatgatagctgatattgcatcgggacagatctctatcatgtatggtttccacggtcctaacttcacaacaacttctgcctgtgcatcttcatcaaatgctattgccgatgcatttaactatatccgtttgggtaaagcaaatgtaattgtggcaggtggtgcggaagctgctatttttgaagccggtttgggcggttttaacgctatgcatgctttgtctacccgtaatgatgatccggaacgtgcatcccgcccgtttagtgcaagccgtgatggctttgtgatgggtgaaggcgcaggctgtctgattttggaagaattggaacatgcaaaagcacgtggtgccaagatttatgcggaacttgccggtgtaggcgcttctgccgacgcttatcacttgacagcttctcatccggaaggattaggcgctaaactggttatgttgaacgcattggaagatgcggaattgaaaccggaagatattgattatatcaatgtacatggaacttcaactcctgtaggtgatgtttcagaagtgaaagctatcaaggatgtatttggagatcacgcttataaactgaatatcagctctactaagtctatgacaggacacttgttgggtgctgccggtgcggtagaagctattgccagcgtattggctgtgaagaatgacattgttccgcccactatcaaccatgaggaaggtgataatgatgaaaacattgattataacttgaacttcacgttcaacgaagctcagaaacgtacagtaaacgctgcattgagcaataccttcggttttggtggacataatgcatgtgtaatcgtaaaaaaatatgctgaataatcgtgtttagcaatataaaggataggataagacttctttttcgtaaggatagggagtcttatcttcgtttttataagatgcttggattctatcccaaagacattagcatctacgaacaggctttgcttcacaaatctttatcagtgaagtctgaaaaggggcgtttgcttaataatgagcgtttggaattcttgggggatgctattttggatgctgtggtggcagatattgtttacaaaaggtttgaaggaaagcgtgagggttttctcacgaatacccgctctaaaatagtgcagcgtgaaacattgaatcgtttggctatagagattggtttggataagctgatcaagtatacggcccgccagtcttctcataacagctatatgtgcggcaatgcattcgaagcattggtaggtgctatttatctagacaggggatatcgtgcctgtaaatatttcatggagcatcgtattattgggccttatataaatttggagaagatttcccgtaaggaggtaaactttaaatccaagttgatagaatggagccagaaaaatcgttttgaggttacctttgagctgataacccaatcacatgatcagggatataatccgactttcgagagtgaagttctggtggaaggtatttcgggaggaaaaggaaccggttattctaaaaaagagtctcagcaaatggctgcgcgtgtggctttgggaaaaataaagaatgattccggctttattgaatgtatttttgcggctaagactgcccgtgagttgcctcaggaggaggtaacggtttctgatagtaagccttcagacagtggggccgttactccggatctttctttggaggagattaagaaaacggatgtggtcgagcagataatcagtgaagcggaagaaaaggcttttaaggaaaacgcttagcggattttatcgatattgtttataatttattaattggctattccggtggttttgggtatgtccggcaggaatacataatacattggaatatgcccgattacatcaagaaaatgtagtcgggcatatttcatatactgacgggaattagatttcatcaggccatgggcagggttttcctgtggctttgaatgtgggacgttgtcctcctgttgctcgcaaatagttccctaattccttggagagccgttttacgatgccgggatgttgctttgctacatcatttttttcactgatatcatttggtatgttgaaaagttcttttttaccggtttcataataatagaccagtttccattcgtctttgcggatagagcagtccagattgatgcctggtccgtcattaccccagatattagggaaattccataccagtgcgcgtcctttggacgggtctcctgtacctttcagcaggggcataaagctgataccgtctatagggttgactgtcttatagtttgtgatacccgccatttcaagtatggtaggataaaaatcttcaattataagatatttgtcacaacgagtattcggggtgactactccgggccagcttacaatcattggttcgcgtattcctccttcatataaggagcctttgccactattgagaggagcgttttgagtgtgaatttgtccgtcgcgccatccgggttcggcagctagccctccgttgtcactcataaaaataataacggtattatctgcttcatcatttttttccaaccagttcatcaaatcccccagacttttatccattccttcaattaaggatgcatatgcggcttctttgtcactaagtccttttttaatatacttggggaagaagcgcatatctttgtcaacaggaacgtggatggcataatgtgccatatatagataaaaaggttgattgtacttttttgctttgtccaatgctttgatagcttcttgtgtcagggcttctgttgcaaatatacctgttccccaataatcttccaagccggggatggccattagtgaatagggctttccatcgcgggtgtgcccgtagttctgttcgctcagataagtagccagaccaccggcggcatgtccggctatgtttacttcaaacccccaatgggtagggttctctcccggtgtgtcaatagaaccgaaatgagcttttccgcagtggatggtatgataaccgttctgtctgagtaactcaacgaaagaagtgccgacaaaggtattgggcgttcctgttacttggctgactccgttgtagttccagtctggcaattctattgtattgcttggtctgtcggtagctttgtttttttcaagtgtccagtttgttacacgatgtcgggtgttgttagcacccgttatcagactgcaacgggtagcggaactgatattgcaggcgtatgcttgtgtgaacatcatccctttcttagccagacgttccatattgggagtttcgtaggcttcattataatgtgttttctgtgtccagaaaggtaaggatgtatcttgccaacccatgtcgtccaccataaataagatgatattgggacgttgttgggttgtttctgaagacattttttcttttgcttgcgtcgagattcctgttaaggaagcgagagcgaaagatacaagtagttttttattcatatcggctagttttataagttatttttcgattacaatttttttgggggtatctatggaaatacttctcagttcttgcttgccggaattttctatccatacttttagtgtacctgtacatagtacgttcagcaccaagcggttctctgttaaagagatagtttggacggtggccggggacagatatttttcctgtatgccaatgactgcccatcctttccgtatggggcagagatgaaacagtttgtctgtaaatccgataagttcgaatgtactgctgtctgatagttcttctgccttttgtgattcccaattataaagcagcacgcgttcttcgggggtggcagacattttctcaaaactgttccgaagagaataatcttctttttttatagtggcctgaacttgctgatgtcggggggaaacattcaggttgtaacagattaatgtcattgctccgttgcctgagggagctgctactcgatatgcttttccactccataatggattggtcagtatagattccggcataggtacggcaggagcttcggggcggaacagtttgccttgtttgtcaattaaaggaaagatgttttccttgataaagtccccgggggcgtccgacaggtagaccggacctccggaaatggccttggaacgtgccatcaaagtgccgcaaacggtatcgcaggaatgaaacatatcatggtcgggccatacggtttgtcctagtagcagggtattggtataagactggaatagatgtgattttgccatatcctcatcatatttcttatagtctatgctgacacgggtgctgttgctgtatgacgtatggtcggtattgatgacgttctgtgccatacagttcattaatcccatattttgccggtggatctcggcttccaggcttcggttacagtcggttgcctggcggatactttcatgccctcccatgtagagtggcagcgtaaaagcttggttatctactttcagaaaatcgaatccttgttcttttaaggtgctgacgtagtagcgatagaaggaacggatgcgggtgctgtccgttcctggcagaaggctgccggcgtgtgggtatagggcttgtcggacgacttgtggaaatccgttttcgggggataatcccatccagtatcccgaaaggctgtaccacagtccgatccatttgattttattttcttttttgtatgacatgatttttttccatcccgacgggaaacgttgtttatctggtatgaaaccggtcagttgcctgttcttgtgggcgagatgaccgtcgtcaatcagtacataccggataggaatgccggatgcctctatcgttttcatatcgtttattatcttggattcgtttatatcatcatgataatgttcccatgtacaccaaccgagatagcggaaagcttcgaaatattccttggctgtgcggctttttaagtcggcggcttctgtatttttcatcagcgcttgataggcttgccgaatggttgaataaatatcttttccttgtcggatgagtagaagagggacttccggtttcagatagtcttttcctaaggtggatacatatagggtgacagagccgttatcgtttacttgcagccagcttaaactgttacggccggcaacagctttggcaaacaagtattctccgtttgtcagttccagcagtaatgcatctcccaacgtagatggggttgcattggaaggtattcccggatagcgggtgtcggttaattcttttaaatcgttgaacacccaaggtaggagccggttggtattgttgggccattcaaaatctcccggacgggagtctcggctgaagaaaatacctcggacgtacccgggtaaccgtaccggacaggcaatagtttgggtttgtccgggtatggatttcttatagggtatgggagaagaaatggaagttaaatcaatcgtatctgtcattgacaaagcgtttgtgttcttgaaagactttcctttttcatatgtgtaatctgtttgcccgaaggatttcggacaaacaaatacattgcaaatcaggatacaaatgaatattgctttatattctctcatgattttttatttgagagttacgttataggcactgaaatgtctgatttcgggtacggcaacggattgggttacggtgaggcgcaaggcggtggtttctaccggttcgaagtgtgcaatgcgtttgtgtcccacagactcgccggagcacactgtctgccattttccgttgactttcgcttctatcttgtattggcgtattctttcgcctttggcaatgtcttcttggatgatgcagtagttgaccggttgtttttcattcagattcagcgtaagccgttgcctccggccttgggtttccgccaatggtgtaccaaagcgccggtttatttcttctccccattcttttaaacgctgttcgtcacctgccggcaatagcccatcgggatcgggggtcagcccgatgattaacgtagcgttgcggcccactgatttttcgtacatatccatcaacgttgtcaatggatagatattattctcgtcatcgggttcccaaaaccattcgtggcggccgttggcaccacgcagggggctgtctgccatagctggtacccagtatttgccttcgggatcaccttgttttaataaggctatttggtctttttggctttcaatacgtttatgatgtgaacagggggccggaaaagtggaccagcaggggtatcccactgtgccggtttctgaacctccccagcggaaatcagcacggtctatgttgtggtagaacaggcagttgggttggtatttattgacgatgggttccacatcaggaccgtcacctcgtgggtcatcggctccgccatcaaaccaaatcatatataaatctccatagcgggtacaaagttcttccaccattttctcgcagaagcgtttataccacgcctgtcggttggcggcaaattctccgtcaccggctaccttgaaattatggatacccagaagtgaattccaccggatgcctacatagatgcccggctggataccatacttacggcaggagttgacaaagtcgcggacaatgtctcctttgccatcacgccattttacagctttcaggcagtatgggtttacgtcactttgccacaatccgaagccggtttcatgcgtggctgtgagtacggcgaatttgcagcctgcggctttagctgcctgaatccattggtcagtatccagttgggtaggattaaatatattataatcttcaatggggctgatacggttattgccttgtccgtagcggatgccgtcgaatacgtggaggtcataatgaaatacggctcccatttccgcttcatgccatttcaattgatgcggtttgggtacaatgatttccggttgtgcaacactcagtacacagttcataaggaagagaagggatgtatatagtatcttcataggttataaataattaaaaaatggatcttctgttttttgcagccatgtttttaattggcttttcaatcggtttaccagtttgggatgctgcatagctatattattcatttggtaagggtctgatctcctgtcgaatagaataatcttatctaccttaccatcggttgcatggatagtaaacgtatgtgtagcggtgcgtaatccccggtagcctgttgccggattggatgactgtatgtaataatagggttggacaatgcggttgttttcttttccgtagaggagaacggaagcaaggtcgaatgtttgtacttcttccggtatttgttgctgaaagcccatgatggaaagcagggtcggatacaagtcggcaaaagctatcatggttgttcggtcggttttcggctttattttttccggccatgagataaggactggaattcgcatggattcctcataaaagatatcttttccggcttgttcatgagcccccatgcagatgccgtggtcagaagtgaatactacaatagtatttttaaataaacccaaacgtttcaattcgttgattatccgacctatattttcatcgactccggtcatgcaggcatagtaattgcggatattgttgcggaaatagtcgcccatttcagtgcctttggcgggaatgtcgggacggttggcacataatgcctctacattcaggtttttatacatctccttgtatcggtcgggcaccaactcgtaaccggtgtgtggagggttcatggatacgactaaggcaaatggctgcgttttatctatatgcccgttgaggtactcaatcgctttgtcggcttcatactccggtccccattgattgacataataaaaactgtcccggggagcgtcagtgtcccagtacatgggttttaaatggtagtcgtaagtgccataagcggtccaatagtcaaaaccgtgccggcgttcttttggacaccattcgttccaagcaactgcaccatggttgttgtaagtatctatgtatggttcatgaggagcatccagatgccatttgccgatatatcctgtttggtatccattggctttaagtatatcactccagcagcgtgcatcttgtggaagttctactccataaggagcgttggcagaattgcaattgcctgttactttgttcttatgcggatacatgcctgtcatcaacatgcctcgtgccggtgaagatacgggatagctgctgacagcattggtgaaattcacaccttcacgggccagttggtccaggcaaggtgttttgacaggttcttttccgagacaacctaaagcatctcctctccattgatctgccatgatgaagaccaggttaggtttttcttgagcttgtaaatagatagaagtcaagaacggaaagatgaaaaatgtttttttagagaaaaatttcatattaattcggtatgatattggtaaagggtgtgttcaaaggtacaataagaatacattgtaacgaattaaactacaccctttttgagttattttatctaaacctattgcagagcatattgattggcaccgacaggccagcctggattttgataaacaacggaagtggaaatatcgcctcctttctcaggggttgaaagacggaatacgtcataagagataggggtcaggtaattcgcttcttcaaagttgtagccattgttggtaatgatcagttcgttggcaaaatgcggacgtaaatatttagaattactaaccactaagccggcagccaattgtttcacatagtaaggctctttttgatactcttgccaattgaatccttctgtttgatagtttttcattttatctagtgaacgccagcgtaaaagatcatctttacgcatgccttctgctataaattcgcaacgtcgttcacggcggatattatataaagttttgtctatcatctgacttccggaccaaacagccagatcgttttctttacttagatctgttgcatcgatagttttttggaagttttctgatacgccggcacgctttctcaaagctctccagtattttttgctataatcatctagatttttgtttttcatatagtcagcttccatatagttgagatatgcttcgctggcgcggaatatcatataagccaaaggtgaattatccgctggagctacattgctgtctctccatcctttacgaactaaatatcctgtagctgttctgcttaagttttgataagcttgtagtagatttgcatagaccattcttccgtcttggtccatattaccacctctccaaaccatatcacccggtttgaaagttgattctacaaggcgtaaatcacgattctccattacatcggggatacttttgtcgcctttgtattctgtattttctggtgcataaataggcaggccattggtagttaggaaagtttcaaccatggatcgtgtataacctccaccttgtcccacacagccttcaccgttttcattgtatatgctatgataattgccttctactaagctattcactttggcatccgcactatacatacgccataataatacctctttgttggaagaaagatcatattgattgaacatattcatataatcttctattttatcagagatttgtattgcttctgccacttctttggcagatgccatcgcttcagtcaggaagaaatctatttcagtattaaggttgccattgaaagtaccgcccggccagcccggaccacctggtactcgtgcggttccttgatggtaggtttcccaacttgcttcatacagggctacacgtgatttaaatagataggcacactctctgttcagacggtgattggtcagattattactgcgcggtaataatcgggcaatggcttcgttcaggtcttctagaataaatcgggccacttcattacgtggcttacgtttgtttgcttccacattggcggcataatcatctgcgctaagttctgatttgataatgggaaaatctccgaatttcctcaaatattcgaaatagatgtaagctctgaagaagtaaatctcaccgatatattgctgagtttcgcgggtatcttccagttcccctttttggatattttccaaagcgtaatataacaatcggttacagtcgcgcaaatgtccttgccgattataacttcctgtggcggcaactttgatacgttgcggtagaaagaaatctacaggatctgttcctgcttggttatcactggtttgatcgttggtaaaaagattggtgtctttgaaatcgggcaatagttcgtatttcttgttacaataagcctgcaattggcttggttctgtgaaaaaaccttcattcacattgtctgtcaatggttctctatctagaaaatcgttacatgagcttatagcgaatgaagttgctattatagggagtatgatgtattttaatttcatgattatgatttatttaaagtttataatgtaatattaattccacatgatagagtatagcttaacggataactcataccgttttggtaaattagttctggatcaaaatttttactcatcttggtaccagtccataaattatctccggagaagaatagtcgtactttctccaggttagctttttgtatccatgctttaggcaacgtgtaacctatttgtatgtttttcaagcggatgtaagctgcattctgcaagtaacgactttgtacctgctggttttgtttacttccaataatggggcgcggataataagcattgagatttgctcccatttcatctccttcaggacggaagtaatccatgtgttcttcgtatccggtggaatcccattgccccccgttgataccccagaaaatcatacctttagaataagcggttctgtcgtcgcctcctacccaaacgtcacgtttggctacgccctggaacattagattgatatcaaatcctttatagtcagctcctaatgagaagccaaaacgaaagcggggtgtgtaatttccaataatggttaaatctttcggatcagtggcagacgtacctttttctatggcaggattgtcatccaggttagcgtacatgatatcaccggctttccaaatattgtttcctacattgggtaatttgctttggtcatgttgggctatccatgattgcatttcttcatcggtttttgctatgcctactgttttgaatccccatatttcgcctaattttttccctttccaataattttcaatggtgtttccgtcttcatctttggtgtaaaatgttttatcaggattgggatattctgttacttctgtttgagcatcagatagattgaaagaagcatgataccctactttaccaattctgtcctgccaagttagttgtaattcccagcctttggttcgtaaagaggtattattcattttgggagctgatgctcctactaatggagttatttcttcggcaggtcctaccatgtctttggtatcacgaatgtagtattcaacgtatccgttcagacgattgttaaatgcaccaaagtcaagtcctgcattatagctggtgacacgttcccatgtgagcaaggaactgacgagaccgggggaagatgctatattggacttgttggctaagtcaagcagccagcgtccgccggcatctacgctacctacagttatattttgaatagaataagtaggataataattatctgtattctgattgcctaggctaccgtaagaaaaacgtagttttaacaggttgacatatgcttctgccggactccagaatgcttcgcgggcgatgttccaacctatagaaacagagggaaatgtgccccatcgttggttaccgcggaagcgtgaagtcccatcgcgacgaatgtttccttctaataggtatcgtccttcgtagtcataatttaaacgggcaaaatatcccattgtagcccattcttttgaggagcctttcaaatcacttgtaccagtggccgtattgatactggggacattttcgttgatgacatcatagcgtttgccgattaattcgttgatgtaataatattcggtattcatacctgctgtaactttgaaattgtgcttgttccaggaatattcataatctgcatatagtgaagttgtcatcatggaagtttgctgtgtttgactttgcacaaatgtctttcctgctgctaaatcggggtctcctcctaaccatgcttcttccacgggttggttgtcacgggtatagagatagactttatttacattatattggtggcggtagctttctgtccgtagagtcgcctgtccgtgaatacctaatccttttaatggagtcagatggaaacctccggaagtgaagtaggtgtctttactgctgtttgaacgccctccagaagttaattgcattaatttaggattacgtgtatagtgtccgttgttgtcatagagaggcatcatgggatataatttggtcgtttctgcaaagaaacggtcgccatagagtttcacaaaagttggcatttctatatctgaacgtataaaacgagcgttaaaatctaaacttagccatttggtgacttgtcctgttacctttccactgatgttataacgttttttgttttcgtcagagtaattcatctgtccgttttgagaaaggaaagctcccgatagatagtatttaactttctcacctcctccggagatacttagattatgttcttgtccgaaagatgttttgtcaatgaagtttcttggccagttttgattatcattggaagcgacgttgaaagggaaaaaattgtttccttgtgaaccattggggtctgaggtgtatgggtattcacccgccatgtatttctgaatgcggtctatcgtatcatcagtgaaaataaaagtggtgccgcttcctgaatttttttgtgctgcattgaaatacttggcaaagcggtaggagtcgagcatgtcaggaatgttggtggggcgtgaccatctgaaattgtttgaatactgaatggtggcttttcctgcttctcctgatttggttgtaaccaagattacgccaaatggagcgcgtgaaccgtaaatggcagatgcggcagcatcttttaacacggaaatgttagcgatatcctgcggatttaacgagtttatgtctccttcggctccatcaattaaaactaaaggtgaggcactggatccggtattcaaatttcctgttccacgaatattcatggtgggattatagtctaatcgtccacctttgtcattcatgtcaatgttcaatcctggcatcactccttgaagagcttgtgaaactgaagtgacaggacgtgattccagtgtttttttatccacggtagcaactgctcctgttaagttcactttcttttgcgtaccaaagcctactaccacaacttcgtccagcgtttgcgtatcttccgctaaagagatttgataaaaagtttggttgccattgattgtaaattcttggggggtatacccgataaaggaaacaattagcacactgctttttgaggcttggattgtgaattttccatccagatcagtaaccgttccgttggtagtacctttgacaactacactagcaccgataatgggctcattgagctttttatccgtgactacaccggtgatgctgaattgctgggcgtacaggaatgtacagttgcaaagcaatatcaaaaatagaattgagatttttttcatgcttctctgttttttaattagacattaggttaatacattgcaaatgtatgttaatcagtgatgtggcttaatacacgttcatttcattcagcatgcatgtttaatgcatctctatattttttggtgaatctttgttgttatctcttttttattttattcctttgctacaggtaatgaattaaatatgaaccttaaaatcttatcactggttataattggagtatgtatattgctgccggatgtgtgctatgcttttttaagcaaagatgtgcatctgctcaatatgcaaaacggattggccgacaataccgtatctgctgtttataaggataaagaaggcttcgtttggtttggaacccgaaacgggttgagccgttatgacggtaggcggattacaaattttgaaaggagtaggagttatcctagtatttcaaacttaaaggaggtttttgacggggtgctggcatttgtggataatggtgtcttttctgcatttgatttgaaaaaagaacggtttttgtctgtggtttcttcttcgggacagggtattccatctcgagggatgttgcagaggaatgattcgttggtttgggtgatttccgggagtgagctgcatttaatgaagcggtgcgcatcaaaagagggtgagcttcggctccgggttcaagaaaaatatacaggctggaataatcaggataatcttttggttgccatcacttattcttcggataaaaaaagtatctgtctgattgatgaaaaaggtagaattatcttgctggatgcgacaaacctgaattcctttcgggtgattgacctggggcgtatcggtagtctgtctgtaaattctgttttgtatgatgatggtcggatatggatttctacaattgctcatggggttatttattacaatgaacgaaccaagaaaatcaagcagttgacttatcatgtggctccggtatccgacagactttctcatacagatgttttcggtgttatcagattaaatgagaataaatatctggccgtaacgtggaatggatatacggtgatgacaatagataaaaataatcaggacgagatattgacagaagtttatagtaacacttcttctttgatgtaccgcaatcttgaaacgaggatgattgcggcttattacgattcacatggtattctgtggattggtacggatggtggaggagttatctggtcggatttgcgtatgcagttttataattgtttttatcaggacaggcataatgagatttgttctattgtagcggatgacgatcattatctttggttggcaacataccataaaggaattatgcggagccggacagcgtttggtacttcggaaaaaatagacttctttcaagtaggagatcaagatgtgaaaaaacaacagactgtgttgtgcagtctgaaagatgagaaagggaatttatggtttgggaattcagatggttcattgacctgttattataaaaaagaacgctcattcaagatattgcgattgatcacggaagatggtgaccttaacaaatcatctgtctgggccttatttcttgatagcaaaggtcgtttttggattggtacacataaaggactttggttattcgaccgtgaaacgaacaggggtaagaagatacatttcaaagtatccggattacagaacttgtctcctctttatattcgtgctatggctgaaaccgacgatcatacgctttggctgggcactgcgaattatggtatatgtaaagtgataaatgaaaaagaactgcagaccggctatgaaaagaagtatggtatggctgagaattccgttcgttcattattagcttcgtctgatggtaatctgtatgtcggatacatggccggtctggcagttttctctcccggacaggatgcgataactcatgtatatactacccgggatggattgtgcagtaactttattggttgcatgactgaggatgcggacgggcaaatctggttgggctctaattcaggtatttcccgttatagccgtcatcagcatttgttttataattattacattgcaggcagtaaccgttctgtcctgcattgggaggatgtcctgttttggggaaataataaaaatcttacttattttaaccccgatgacattaaagcgtttaccacttccgaatctgtcgtgattaccggattggaggtaaataataaacctgtagagataggaagagaggtcaatgggcagaccattctttcacaaagtattttctatacgccttttgtccggttgaatcatgcgaatcgtgactttgcgctgacgttcaataacctttcttattctgaaagccagcagaagtatagttacaggcttcgtccttatcagcctggttggcttgtggccaacggaggggaaaaagtttcgtatgctaaccttcctgccggggaatatgtttttgaggtgaaaaatatttatccggatgaaagagacagtaaaataacctcgttgagagtagagattttgcctcattggagtgaaactttctttttccgcttctgtatgatggtgctgggagggataatagtttatatggttatgcagcgtattaaattacggcaaaagaggttggagcatgagttgcgcttggaacatgagatatttgctgctactgtagagcgtgacaaggagaagcagattcggatggaacgcgagaatttctttacgaatgcagctcacgagttgcgtacacctttaactttaatcttatctcccctgcaggaattgttaggaaccgtccgcccttcagacaccgtctatactaaactggctgccatgtatcgcaatggaacctctttgcagacattggtcgatcatttgctttatgtgcagaagattgaagcaggtatgattaaactccggatttcgaaagtcgatatagtggtattggcaaagcagataaccgatccttttcatgaactggcagaaacagaagggattaactttacggttgaatcgctgaatgagccacttttgctatggatagacgtggaaaaaataagttcggctatccgtaatttattatctaatgcgtttaagtatacatctccgaatggaaaggtgatttttaagatgaaccgtatcgagatagatggatattcattttgcagtataatcatatcggatacaggtaaaggaataccggaagagttacgggggaggatttttgaatcatttattaccggagaaaatacacctttgttttctaataaggtaggtataggcttgcgtattgttaaaaatacgatggatcttcatcatggcacggtgaatttggacagtactcttggaaagggtagcactttcacattattgattcctgagggaaatgcacattttgcagaggaccggtatgagattgttggtgctccggagatggaggaatatgctcttccgttaccggtaatgcaggcggaagggcaggaagacaagccttcgaataaaaaaacatctcttcttgttattgaggacaatgaggaaatccggcattatgtctgttctttattctgtaaagattatgccgtatatgaggcggcaaacggtgaagaggggggtgatgtggcaatgagtaaaattccggatttgattatttctgatataatgatgcctgtaaaagatgggtttacctgttgccgggaattgcgtgagcagcctcggacagcacatatccctattttgatgctgacggcaaaggctgaggatgcggatgtgttgcaggcttcaaaaataggtgtggatgattatatgatgaaacccttcaatccggaggtattgaaggcaaaagtccggaacctgatactccagcgggaacgcctgaagaggatatatacaaagacgttgatgttgaagcagcaggaaagtgaaccggaagcggatgggaataatgctccggatgattttatacagcaaattattcatgtcatagaagctaatctggcgaatgagaactttaatgtaaaaatgttggcggagcaattgaatatgagtcagcctaccctttatagaaaaataaagcaacgtagcgaactggctgctattgatatgattcggagtgtacggatgagcaaggctgcctcccttattatggagaacaggtattccattcaggaaatagccgaaatggtaggatatagtgatacacgtacgctccgaaagcattttaccgagcaattcggagtgtctccatccaagtatatggaaaaggattgaatctgcttcttatccgaagcagattcccatccgtttgccttgtacaatcaggtcatggttctcattgacaagttttaatttaccagccacttcattcagagggatggagccaatttccgcaccttgcagagagaccattcgtccgaattgtccggaagcaatcagttctgtggcatgtccacccatacgagtggccagattacggtcgtagggagtaggagagccgccacgctggatatatcccagtacagtttcacgggtctcgaatccggtttcatattctatttcttgggctatatattcggcggcttttttgccgtccatggttttgatgccttctgcgacaacaacaatggaatagggcttcccttttttcaagcgttcaatgatggtattgcctatattatgaatatcataagacagttccggaataagaatcacgtcaccgcctcccgccattccggaataaagtgcaatccagccagctttatgtcccatcacttcaataaccatgacacgttggtgtgaactggctgtagaatgcagccggtcaatggcatcggtagcaatggttacggcagaatcgaatccgaatgaaacgtctgttccccaaacatcgttatctattgttttaggtacggaaacaacgttcacacctgcttgggccagtttggctgcggtcttttgggttccgtttccgccgatacatacgatacagtccagacctagatcatggatattctttaacatcaaagccggtttgtcctccgaggctgccgacaggcgtttcttgaatggcttttctctggaagtgcctagtattgtccctcccagatttaacaagcccgataatgatttttctgtcaatggttctacgtcattgtccagcaatccccggaatccgctatgaattccataaacttccataccgtaatgatttatcgctgttttgcaaactcctctaattgtggcgtttattcctggacagtctcctcctgatgtcaatattcctatcttcatagcctttgatgttaagttgtaagcgaccgtaaagataacaaaaaataaaagtaatgtagaaaactataaaaaaaataatgttatcagccattataatatagaaataagctatttttgcaagatataacgaatcgtatactaagacaaatgaattctaccagattaattagtacgctattcaagcccagacaaaaagcgacagccttgtatgcaactcaggctgaggcgctccaacataaagtgttttgccggctgatgaaggatgcggcccatacggagtggggattgaaatatggctataaagacataaagagatatcaagactttcaacgtgtacctatacagacttacgaagaaatcaagccatacgtggaacggatgcgtcatggagagaaagatgtcctgtggcgtggagaagtgcagtggtttgccaaatcttcaggaacaactaatgacaaaagtaagtttattcctgtcagcagggagggacttcatgatattcattatgcgggtggtatggatgcagtggcgctgtatctccaacaaaatcctgagagtcgttttttctctggaaaaggtctgattcttggaggaagccatgcaccaaactataatgtgaaacgaagtcttgtaggagacctttctgccatattgattgaaaatgtgaatccgttggtcaatctgattcgggtgcccgataaaaagattgcgttgctgagtgatttcgaggaaaaagtagaaaggattactcgtgccacaatgaatcagaatgtgaccaatctttcaggagtgccgtcatggatgatggctgtactgaaacatattctggaagtgaagggaacggataatttggcggaagtatggcctgatttggaagttttttttcatggaggggttgcttttactccttatcgcgaacaatataaacagcttattcgtagcgacaagatgcattatatggaaacatacaatgccagtgaaggttttttcggattacaaaatgatttcagtgatccttccatgttactgatgattgactatggggtattttatgaatttattccgatggaagatgtcggtactgaaaatcctcatattgttccgttaacagatgtggagttgaataaaaattatgcgatggtcatcagtacttcctgcggattgtggcgttatatgattggtgataccgtgaagttcaccaacaaacacccctataaatttgttataacagggcgtaccaagcactttattaatgcatttggtgaggagttgatggtggataatgcggaacaagggttggcaaaagcctgcgaggcgaccggtgcacagattattgattattctgctgctcctgttttcatggatgcacatgccaagtgccgtcatcagtggctgatagaatttgccgttatgccggattctttagagaattttagtcgggttcttgacacttctttacaacaaattaactccgattacgaagctaaacgccataaaaacattaccttgcagccgttggaaataatcgtggcgagacctaatctgttccacgattggctgaaagaaaaaggcaaattaggcggacagcacaaagtgccgagattgagcaatacgcgtgattatatagaagaaatgctaagcttgaaccaataagaacatgaattggaaaaaacataaattacctgctttgttgatgctgatgatcgtggtgtattcctgcgcaagcatgggaacaccggatggaggtccgtatgatgaggagccgcccaagtttatcagaagctctcccaagccgtatgcaacaaacaataagaataagaagattgccattgaatttgatgagttcatcaaattagagaaaacatcggagaaggtggtagtgtctcctcctcaattggaacaacctgatattaaggcaagcggcagaagagtattggttaacctcatggactcattgaaacccaataccacttataccattgatttttcggatgccattgtggataacaatgagggtaatccgctaggtaattatgctttttctttttctacgggagaagccattgatacactggaagtttccggaaatgtattggctgctgctgatttggaacctgtcaaaggtatgatggtgggattgcatgcagatctgagcgatagcgcttttgtcaagaaaccgtttgaccgtgtatcccgtactgatagccgagggcgttttaccatccgcggtatcgcacctggtaaatatcatatctttggtttgatggatggtaaccagaattatttgtatgactccaagaccgagatgattgctttttgtgattctattattattccttccatggaggctgctgtgcgtcaggatacgttgtggaaggatacagcgactatcgatacgattaaaacagtggggtatacccgttttctgccggataatattgttctaagagcatttaagggaataaataaccgccagtatctgtccaagagcgagcgtgataaagagaatcattttatattatctttcagtgcgccggccgatacgttgcctgttttgaaaggattgaactttgatgagaaggatgcgtttattatagaaacgactccacgaaacgactcaatttgttattggatcaaggattcgttggtttatcagatggatacgctggaggttcagttggattatttatatacggatacactaaaccggttggttcccaaaaccgataccatttatctggctaataaactgacaagagagcaacgggaaaaattgcagaaaaaagcgaatgaggaaaaggagaaggaacgtaaaaaaagggagaaaaaaggagataccatcagggtggaaccaactaaattcctgactatgaacgtcgatgctccgtcagcattcgatatatacaggaatatctatctatcttttgaagaacctgtggcaagcatagacacggcggccattcatatggaagtaaaggtggatagtgtgtggcaaccggctcctttcttctttatggctgactcgttgatgccacgtcaatatcagatattggcagattggcaaccggagcaggaatatcagttgactattgattctttggcgtttattggtatttatgggctgcatacggacaaagtccagcaaacggtgaaagtgaagaaaatggacgagtacggaactatcttgttgaatataaaaggagctgctccccatgctgttgccgagttgttggatgcgaatggaaatgtattgcgccaacaaccggtaacggaggaaggaacggcggacttctatttcttgaatccgggtacgaaatattatatacgtttgtttaacgaccataataataacggagtttgggatacgggagattatgataagaagattcagcctgaagaggttttctatttcccgaaagtttgggaaatgaaagctaattttgaatttgaagagaattgggatgtgaatgctattcctatagacaagcaaaagctggatgaaataaagaaacaaaaaccggaagagaccaaaaaggtgcaagatagaaataaagaaagagctagaaaactaggccgatgaaaaaaactattctcatattattgtgcggctggtttgccattatggcaaccagggcgcaatgtgcggcacaaaatgaagctatccaggcaggtgaagaattagtgtacgatttaaagtttaactggaaattcatttgggttgctgccggacaggcaaaaatggacatgcaggctattacctatcaggggaaaccttgttttcgtagtaacttgatttctgtcagtaacagacaagttgatttcttttttaagatgcgtgatacattgacttgtattaccagcagtcgtctggaacctgtttattttcgtaaaggagccgaagagggcgaccgctatacggtggacgaagtatggttcagttataaaaacgggaaatgtattgccgatcagcgtcgtatgaggagggaacgggatacggtgaaatcgaaagaccaaagtgatgagtgtatctttgatatgctgagcatattgatgagggcacgttcatttgatgtaagtgactataaagtcggcgataaaatattgtttgatatggctacaggtactaaagtagagcagcaaacattgatttatcgtggccggaagaattttaaggcggagaatggtgtgaaataccgttgtttggtcttttccttggtagagtataaaaaaggaaaagaaaaagaggtaataaccttttatgtaactgatgataaaaaccatttgccggtgcgtttggatttatatttgaattttggttcggcaaaagcatttctgagagagataaaggggaaccgtcatcctctaacttccattatagaaaagtagcggtttgtcttgatatagtaataccgccgggccttggcagatgccgggtcggcggttgtgttgttgtatattcattatgaatggtatgttattcatcgaacagtttggcctgtctggaaataagtttcaaggtctttccttcatttaatgcagtaagaatagtttcaccccctttgttcactttgcataaagagattttcggtcccatgatttcggtaatccgtatttcaccgattttggtttctatattatgtccttccagtatgccatcttccactacatcaaagcgtaatccttctttgataggatcatcatatcccaggttgatataaatggtttttgccttgtctcttttggtagataccactttcagtattgaaccgtatactttgaagtgattttctacaaaaagtcccatttcgtatggcacattgattaatgaattctctaaagcgctatattgggtggcatctttaccggatgctgagcctgtctcttcataattgcgtgtgctgatagttactccgtcactggtccgtattaaatcaaggcgcagggtgaatttctctttataactgttctcacggctgtggtaacgtctgtgagagcttccgtcatcggttgcttccctttgtatcaggtttccttttaacaggtactctgctctgaagcggcgtgcatcttccagcgggctcagactgagatcacttccagccgaaacggcgtccactacattgatgcggttggtgttgcggataccatcgataaatgcgagacgaatcaggttgatcgccctgttgggtattttgatctcactattgaagtcatccacataaatcgtatatttttgtccggatgcttctaaggatatgactgtcaaaattattaataataggatattacgtttcatggttatacgaatttgtaaggtttgtaatgtagttcttttacgaaaatacacagttcgctgtttatttgcaagtgaactgcgttaaaatagattgcgggcattgattatttattgccggtgtttattttttcatgtttaagtatttggtattgacagataatgattatcttggtgcataaattaaaaggtagcttgtatatggggaagattcaagagaatgatgcaaggttgcagcagcttgtatcaatggcacgcataggatggtgggaggtggactttgatgaaggagtttactattgttctgagtttgtagccgatttgttaggaatagaagggaataagatttctgctaaagatttcgcgaatctgatttgtgagaattatcgggagcgtattttggaggaatttcgctctttccggatgatggagatttatgagcaggtttttccgatacattccaaatatgggatgatgtgggtcagtaccaaggtcggtgagaagcgtattaccaaagaaggtcatgtccgcgtcatgggtatgttgcaatgtatttcccggcaacggatgaatatgcaggagcagacggtagaccggttgaactctttattatctcgtttgaacggcatttccaagtcattgcttgattttttgcattctgatgatattaccttggttatcaataagattttaaaggaggtattgcgccaatttcaagcagatcgtacttatatttttgaattggacaggaaattgcatacggaagtctgtacctatgaaatagcagtggagggtataaaagaacgtaaggttttattgtcggaatcttctattgattatgcctcctggtggacaggacagatattggctggtgatccaatcattctttttacattaaatttgcttcctgattcagccggggcggataagcgtagattagaggaatatggagtgaaatctactatggtggtgcctttgaactcaaaagacggagtgtgggggtatataggggtggatatggtgcgtgagcaccggaattggtgcaatgaggattatcaatggtttgtctctttgggtaatattatcagtatttgtatggaattgagacgctctgaatctgaagcccggctggaaaaagcttatttgcagaatatttataagaatcttcctgctggtatcgagttgtatgataaggatgggtttatgacagatttgaatgacaaggagatggaaatcttcggtctccggcataaggaggatgtgataggattgaatttatttgataatcctttgctgccgcagggattgaaagataagttgaaagcaggagcacctattgatatgtcgtttaattatgatttcgaccgtttggacggctattattctacttctcgtaccggtactatcagtttgatctcgaaattcgctccactttatgatgctttgggcaatctgataaatatattgttgatcaatattgataatacggaaacaacaaatgcatatagcaaaatacaggactttgaggagttcttcacattgattggtaactatgccaaagtaggatatgcccattttaatgccttgaaatgtgatggctatgctgtgaatagctggtatcggaatgtaggtgagaaagaaggaactccattgaatgagattatcaaagtgcattctcattttcatccggatgatcgcaggatgatgcttcgcttctttgatcaggtattgatacgggaagccagccatctgaggcgtgatgtgcgtatattacgtgaagatggcacgtatacatggacaagagtcaatgtaatggtacgcgattttcgtccggaagacgggattattgatatggtttgtgtcaattatgacataactgaactgaaagaaacggagcggaagttgatagcggcaagagataaagcggaagagctggatcgtttgaaatccgcttttctagctaatatgagtcatgagatccgcactccgctgaatgctatagtggggttttccagccttttaacggaaacggaagatatgaaggaccgcaagcagtatatggctattgtacaggagaatacggagttgcttcttcagcttatttcagatattcttgatttatcgaagatggagtcgggagcttttgaatttgtcaagagtgatacggatgtcaatctgctttgcagtgagattatccgttctttacgcatgaaagtgccggccggtgtggagctggtgtttgaagaatgcttgcccggatgtcatgtatgggcagacaagaatcgtttgaatcaagtcatttccaatttcattaataacgctttgaaattcactttttcgggcagcataacgttaggatattataggcagacagatgggtatctgcggttttatgttcgtgatacaggaatgggaatcccgaagaataagataaaaacagtatttgaccgttttgtgaaactgaacagttttgttcatggtacgggacttggcttgtctatttgtaagagtctggtggaacagatgggtggaactatcggtgtggagtcagaagaaggagaaggctcttgcttttggtttacttatccttatcaggaaatagctggtagtattctggtaccgtagaggggtttgattaataaaggtttatagctgtaggggtgaattgagttcatccggatacattgattttgtggtatcgggtgggagcatttcacccctacagtgaaccgggattatatgttagtctagtttcttcatggcgctgtgtacggaacctgcccaataattgcgtagtccgaaaccgcgtgctttgccgttagtcggtgcactatacagaatctcacgggttttcgtgttgaagaatacaatttgataggtcgctcttgcatctgccttgtttaaaagcatggcaatcataatcaatcctgttttttcttcttgagagaggataggaagtgtcttgatgacttcttctatctgtttttcatccagggtgtatccgctgttggtcgtcatgatctcatcgggattgatggtcttgttagcatcgtttactgcctctaatgaggtcacttctacattgacacccaatcttttgccaatatcatacttcttcggttcagtgatgaaaagcttgttgatgtcatcaaaagtatatttgaactgcatggggccttctttcgctccgtacactttggcacgggtaaagtctatgccataaaatgtcacagaagagatgtctttcaatgcgtctttgttttgcccgaagcaagccatgctgcttacaaggaataataaaacgagtaactgtttcatattagttcttttttaagtgttgttttgttgctgccaaaggtagaaaaatattatctcaaatcaataaatttaactatttttcgactcatgggcggcatttgtattttcgcgatatactctgccgattcaaaattgatactcggagccacccgtactttggaacggaacaggtctttgatttctttagcgaaggcttcgctgcggttttcacttccgatgcggatcagtatttcatccgttcccagttcattggtataaacctctacaatgtaattcttgatatgggggatgttatccagaatatcgaataaagcgggtgggtaaagggtcgtacctttatattttatcatttgtcctttacggcccagtatggagctgagacggatggtgttacgtccgcaggcacaaggttcggtataatggtaacagatatctccggtcttgaagcggagcagcggcattcctcttactcccaaagtcgtaatggtcacttcgcctgcttccccttcttttacaggttggttgttatcatccagaaactctacgataatcagttccggctggaggtggccaccgtgaaattcattacattcggtaaacgaggattgcatttcggtagatgcgtaggtggagtaaagttgcagggaatcccatttctcgtgtatccgtttacccagtgtgttcagggtgaaatcgggattgcggagtgcttcgcctatgcatacacatttctgcatggagcagtgatggtaatcaatatggttcttttcggcaaattcaatcagtttgatcagaaaggaagggactaccatgccgcaagtgggatggatgcgccggatagtgtcccattgcagttcgggaatgccgtttcccacacgggctacccccatgcccagctcacgggctcccatatagtaggctagacccgccatgaaacgtctgtcgatagtggtcatcagttgcagtacgtcttgtctgctgcatccggtggtggtgaatgacagatattcgttgtaggccagccggtcaaggtcctcggaagtcaatacgaaagtgacggggtcgcccaaggttcccgaagtggtgacatagtcaataatttcatcgcggctcacgcaaataaaatcttcattatgaagttgcaggtctgtcttggtcgtgacaggtatttgttgcaagtcttctatggtttttatctgttgtatatcgatgtgatgtgcttggaacagacgttggtagaatcgtgaatgattctgcaaataaagcagttcctcagccagccggctttcctgataggctttgatttcttcaggggagcggaattgtatttccggattcttattcattttagttgtttattttatgttctatacgttctgattcacttcgcttggggataggaagcaagagggctttcttccaattgcgcagggctttgtcctgctgtcctgtggcatgatagtaatctcccagcaactcgtacacataaaagaaatgagggttggcatgttggaaggcatgcagggtctgttcgtccagccgttctttctttttaatctgcttccgtagtacaggagccagtcttttgtaagtcatcagctgttggtattcctgttgttgcaggaaggagtccgcaggcactgtcaggttttcggtatagatttcatggttgaaatcgatggagtcgctgaaaatcctgttcaggtcgtatgccacgtacttgccgcattgccagggagcggtggatacccacatccgttttttctcgggttggaaaatgacggagtgatgggcgatgaactggttgatggccatttcattggcaaggcccagttccgcttctcccactcctttccggttgcgcaggatagaggcggctttgggggcatctatcggtgcgttttctttcagcagttcctgcaagcgggcaaagcggtaggggctgtccgaagtttctatgttttccaggttccgtttgtcatggccgaaggtttccgactggtagtggttggtacagatgatctgctgcccgtttcctgtgaataaggctattttctccggcgatttctcgataattgcggctctgccgtccttggccgaacccaccagtatggactccgagacaaatgttttccgtttccgggcgatagcgtatgcttcctcaatggtagaagcatattgcaatatttccctggtcagaatggaaataggggtggcggatgcggcaggcagatccgatttggcggcattgatggtgacagtcagccccgtttcattcatgccggaaaggacaccggtcattccggcccatcccacggatgcgaagcgatatccgttttcgggttggtaaaacgaaacgagcttgttgcgtgcaaaggcgtcacccatgtagaaatcgaaattacggccgatgataagggaagaatcggcactgttctcaccccagcaggcaaatgaactgcatcctaccagcatatagtcctgcatggcatgtcccaagtcgtgggcggagtggtaattcaactgacgctcgtagggggtgccgatgaaatcatactcatgggtgcaggagagggagatgccataaatctcgtcccggtactcttccggcacatttttccccagattccggttgaaaaggacaatgaagaaacggaggaatttaagataactttcagaggggactatctcttttatctgatccacaaatactttttcctgaaaataaagtaagtcggaagtcagttggccgatggctttgcctctttcgtaggcaggtccgctgactttcagttcccaaagtccgctctcactgtgccgcaggtagtttccgccatactgccggaggctgtctttccgtatcacacgatccgtttcaggggtagacgcaaattgcggagtcatcatatcggcagatagatagagataactcatgcctatcatgatcgccgctatcagaatcaacagggccatccccccgtactttattgttttcttccaaatcttatgcattgcctactttttttgctaaatattcctgacctacaaattccgaacaagtgagcatggctgtcagcgtcacgcccaaggcgccgtgtacattcagattctgccccgtgaggaacagattcttcagtttggtgcgtgtggaaacaaaactgatttgcggatactggtagtttttgacaataccgtatgccgaaccgtctatggttccggtatagtcccgatagctcagcggagtcgtggtatgaatcttttcaatgcaatgattccagtgaaacccgaaccggttcaggagctgcaagatctgttccgtcttttcttctttgaactggcggtatgcctcgccacggtgttcgggagtcgtatccgtccattcgctgacctcatccatatacatgggggtcagtatggaaaccacctctgtgaatttgctgttgccgcggggtacttgcatggagatcatgcaactgggggtattccctttgtgcatctctttgtcataccatacatcctcattgccgtgcaggtatatattatggttctgataggggcaacagtcttttttcatcatcagattgagcgtgaatatcccgtaactgttttccagtgacttgatgcgagacacaaaagccggtttgatggaatggttcttatccagcagggataaggtgagttgcggatgcaggttggatatgacgtaggtactttccagtatctcttcatggttcacttccactccttgtatggcttcatccttgacaaggatacgggtcacttctttccggttcagcaccgtgccgccgttggcacgtatgatatggattaattccagactgacttgcatacttccttccgtgaaacgataggcgctctccagataagagttgttaatcatggcgtgctcatagaaggtggatttatttttgatcccgccatagagcagggaggttgcggcaagtacattctgtaaatccctgttcgtggtaacggatgctatcatcccggctgctgaggtggcaaagaaatccatgccttcttgggacaggcggccttttttcaggtggtctatgctgatcaggtttcccaccgatcggatagctgccacataccgttttaagttctcccgttcatgggggaatgagtggcacagggtttccatgaaccgttcatgccccatggcgtaatcatagatagcgtctttataataaatccggtcgaacacttcttcatccatccgtttgatggataacttgtccatgataccgaaataacggaaatactgattcatgatttgtccttcatccagactgccgatatagtgaatgccggtatccatccggtgcccgccgcgttggtaagtctggaagcagccgccaaacagttcattcttctccagcacacagacgtggtagccctctttgctcaagatggctccgcattccagaccgcccagtccgctgcctatgatgatgatatcgtacttactcatgttccggtttgtttttttggaagatataaatcgtattcgaggtatatctgtcattaggtaaaatctccagctgcatcccaccttcttgcgcgatgctccttatttgcgcttcggatgtgaaacaaagttgttctgtcgtcttgttgaaactgaaaatgccggtagacagcagttccgtgaaacgggtgaggcggtgtttccgggtgttggcggcattgccgtcccgcacaatcagctttccttccgggcgcaaccgctccatgcatctgagcaataaggtccgctggtgctcatagctcatataatgaagcatgtcattcagtatgaatacgtcactttccggcaaagggtattccaatgcattggcgcatacaaattgcaggcggggagtgcggagccagccatgctgcgccacggctatcttgtcctcatcataatctatccccgttatttcccgttcctcggaaagttgggaaagcatatagcaaagcggtccgaatccgcaaccgatatctgtaatctgtcctttgacgggaaccagccggttgaataaccggtagttatcctccattttcaccttgatgcgtatataccattcttctaccggtcctttatagatatagttctgtatcaggttctcgtaaaagacgggattgtccgttgtgctttgctcccggcagatacgggcatattcttttttcatccgtgcggagatgcttttggtacgttcctgataagtggttccgtacgtagcatcgttggccgggatacgcggcagaatctctgtcagcatgatgcctttccgtacattgaacggctgtgccttggctatgatcttgcagttgccgtaaaggatgaccggaatgatatccagttgcagtttttccgacagatagaaagctcctttatggaaacgcttcatccgtccgtcgtaggtacgtgttccttcggggaaaatggcgatggaatatccttctttcaccttttggcgcatccgttccacgtaaagctcgtaaccgtctcctacgtaatagaaatcggcatagcggataatggctccgaagaaaggagagtgccatacccagtgattggtaaccatgaccagtttgggagtcagagccaataataccagtatatcgatgaaagactgatgattggctatcaggatggcaggctttttaaacgtttctcccgtccggtttatcttttctttatgtacaaatgtggctatatggatcaggcctttgcaggtgacatgtatcagttggcaaagtacttgtttcttataggctttgcggataggaagcaaggtcatgacagctatcagcaagcgcaggaacaggcatccgataaagaacagcaggaacaggccgccggttcttgccagtcctgtcaatgtataaggaggcaaccctttggaagcgggtgctgtgatgaagaaccggaaaaggatgggttgcagcgtgtaggctaccagtacgacggcaatcattcccaaaatggagatgagggaaatggactgcaatgccggatggcgtgcgaagaccaacgtacccatacctatcacggtggtgaaagcggagaagaagatggctgtcttgtgcgggttcagcaactgccgtcctgtgcggtacttattctgcaatccgtccataatgaaaatgctgaaatcatccccgattccaaaaataaaggtggacagaatgatgttgatgatattgaattcaatacccagcatgcccattaaccccacaatgataatccagctgaccaacatcggcaggaaactcatcagggtcagttctatgcgtccgtaggagatccataaggcaaagaaaatcagaaaagaggagatataaagaatcagatagaaatcctgattgacggctgatacccattggttggcgaaatagctgcggtcgaagataaccactttctcttttggttggaaaagggggtacaccgcttccttgtcggtctcgttcatccgtacctgagtaatcagcatggtcagggaatcggcggaagtctgccattcgttcagaagccgggtagtgatttcattctggtagtccaaaggctggaacggacggtcgagccattggaaaaacggctcgaatgcatgttcacgaaaatgataacgggcagcctctgtccggatggtttcgcgtaaccgggctttcttttccggagtccagtagttgtgccattgtttcaaccgtgcttcctgcacctcttccggtatcagaaactgtccggcagaggcgtaatcttttatttttccttcttctttcagttgggcgagcagccggttcgtttcggcgtattgtccggtagcgtctcccatatctttgcctgtactgacaaagagaacagtcttttctttcttgtcaaagagttcggccagcttgttttccgattgtttcaagtgggcaggctcatagttcagactcatcatatcctcgttgaaacgcacgttctgcgaggtgaataaacatattatggtcagcacgagaatgccccctaccaagcctttgttcttttcgtatggataagcgttcagtttctcgataaagcgtagcaccgccccttgttttacatgcgcctgccctttcaggaaatgcggcagatagaccaggcaaaacagcgtggttcctatcaaggcaagcgaggcgaacagaccgaaatcccgtaacaggttggaactggtaaagaggaggccgaaaaaggcgccgatggtagtaaaactgcctacggtaagcggataggcgatttctctgattaattgttgtaccgatgatacatgattctgatgcgccagcatgtgtatggagtagctcaaggcaatgcccattacggcggagcccgcacctacggcaatggctgaaatgccgcctttgataaagtagatgaggcataaggcgaataaagctccgaacagcaccggggtgatgataagcggaatggatttcttatgcttgaataccagagatatgaagacaatgatgataatcagcgcgatggaagaagtgaccagcgtatctttctttatctgtcgtgcattgtacactcctacggaaggacctccgaaatattcggcaaccaattggggatgttccttttccgctttttgcagctcattttcaatcagccggatgagtttgtcatttttgcccgtgcttccggtgttgaataccggggtgatgaacatcagcagggtggaaccgtcccgtgagaagatatgttcattaatcagttcgtaattagcttccaactggaagtcttgcaggtgtttcagcgtctggctgcccagtcccaacgggtcccgcataatgtagttcttcaaggcgaatcctgccggagatatcaggttggaatagttcttctgcatcagggcggcaatgtttccggcggtaagcaaggtgtccagccgttggtagtcctcgtcggaaaggaacaggggcaggttgtcgtaaacaaaatctccgacactgttgatcaggttttcgtcggcttttgagaagatctctttaatcagggttccttccgcttgttgctgtaaatcctgtttaatggtttcggcagcttcaatcagggaatccgcatccgccacaccgtccttgccggacagcatgatcataattttatcctttatcttcagattttcaaatacgttgatggcattttgggagtccttggtatccggaaagaaactggttacgttttcctcgaatctgacttgggcggcaaaaagggccataaagaggatgcatacgctgagggacaggtaaaacaagactttatgcctttcaaaatagttatataatccaacaaagaatttagtcatatccgttttttctcctacatatagccagcaacacggtggagattactccagacagcagactgcaagccattgcaaagataatgcttcctattaaatattgctctaaaactgatttgacattttcaagagaaaggtctccgagatgcaaatcgggaggattacccagtaccatgcagcctgtccggtaactgccgtacagcaataggggaatcatgggtggaatactgatattggcggcgacaagggcaatcactttattcagtctgaacagatgcgcaagaaagagggtgatcagcatctgataaccccataacggaacgatacccataaaaatccccagcatgatggcgagtacaatcttcaggttggattcccgtgtattcagcacatggtcggtgaagaatcgcttgcagttgctccatgacagtttgcggagcaggttacggggaacaatccaaaggcaggtaatcagcaccagcaccgtgttcagcacactgatacgggtaaaatcccggaacggccggaaatgggatacccgttctgcttgcgggggataatacacgtggatgggaatgttcttcaccgctacatctccccatgcggtaaagacgatggcttccaactcaaattcgtatttggcggtgtaccagcagctttgcacattcattttgcgcagagggtaaaggcggtatcccgattgtgtatcttccagtttcagcccggtttccagtctgaaccagaaattagagaatttattggcaaaggtattcttgcccggcatattgtcggaggctaagtttcgggcgcctaccagcagcgtgtcgggctctttttcaatggcttcgataaaacagggaatatcggaagcgaaatgctgtccgtccgaatcgatggtgatggcatagcggaaaccttctttttttgcttgggaaagaccgtgctttaaagcggttccttttcctttattgacaggatgggtaatggtgcggatagccggatattgttccagaatgttggccgtatcatccgtagagccgtcattgacgacaatgatatcgtctgcatacctgcatacctcctcaatgactgccgccagtgtcttcccgttgttgtaggtgggaataacgacgacaatctccagttcctttagtttcttccgccaaaccgatgttgtgtttgtactcatcttgtttttcagtcaaactattcagatacgtttgggatgaatgttttcgtacctgaacttatgtggtttctaatgggtgacaaagatagtatattttcggatgcgggcattctggcgttaattatttatttggagatgcatttttaattttaaagcaggtaaacaccaacttgttctcgtcgaattgcggattttccagattgttctcggatatatacagtccttcccttcccacaaaactctttttatagaaatatttctttccggggaattttgtttctccgatgatttcaaaatccgcgttcagtacaatgacggagaactcctttcctttgggttcgtcataggggctttcgttggaagccagtttgtaaggcatttcagcaaaacggtagtacacattgcggtatttgtcatacatgatatgccaatatctaggattttcattgagttttataatagcattaatgccttccatagaattacccagtttgggcttcatgcttttcagatatctgcttttggcgttataccatcggatatgtttcaagtcatctgtaaccatcaggctgtcatatccgaaaaatccacagaccaaacggctctctttgtagttgtaatcataactaaaaccgtatcctcctgcgatattgtcatattcctctttaaagatgggtggatagaaaataggaatccatttaacttctcctgttctcagatcctgtgaggcgaacatatgggttctaggccagtcttcctttttcatatcgggttttaaaatttcttggcgtagaaatatgcatgagtctttgataaaagcaggtgcattgtagtaactgccaaaagacaagggtgtaaatctgccttcaggagtttggaaattatagtttcgtattatttccccttgagagtttatggaactgagccgactgatattattctgtgcaactaatatatattgagaatcgggggaaggtctactgccgaatacagctggtagcccgttgggacctgtcttgtgaagaggtatccgtttggctatctgttgattctctatatcaaaaatgacaatgtcatataatgatttttgtgtattctcaaagtgaaggtattctttcccgttttcttcgaattggaacatggatttgcttaagtaataggtctgttcgtctaaagggaaagccagctgtttttctgctaccagttctacttcgttctgtttgccagcttcgttttttggggaggactggcaagatacgaggataaatatagaaaagagtgatataaaaaggagtgttcgattcataatattttcggttttatgatgtatgtaatttatgtgaccggatttctaaccggccacataaattgttggttgttaattggtaggagcaccatgattcccaccttctcctgaaccttcaccgggggcacctacctctactccggtgccgcatttaccatcttcactgatacacacagtgcctgtagcagccattttgcaattttcccattcagcttcgaaagcacagtactttggaccccctcgtggcatttgcacggcaggtgctccaaacactacttcctcattagaagagtggaggttcaagcttattgcaaatgttgcaataacagccataatcattgtgaattttgttttcataggtgtcatatttataattgtctgaatataagatgtttaatgggtgttgacaactataaatggacttattgttcttgctattatggatatttaacagaaggacttgcttcattgatacttacttgccatcagtaccgctttcaacttgataaattcttttccattacaaatgccttctgcctgcaacttgaaaagatgctcttccgttttttctaatcggataaacagctgtagtagcggagtttccagcgggttgatggcagacaggaatttggaagaagcaatctgtacatactgcaaaggttggttggcgatctgttcggcactttcttttattatctgtaaggtacagacgcccggaaccaccggctgtccggggaaatgaccttgatagagcacatggccgggattcagctctatctctattgcctgttttccgtcttctctttcctttatatgaatgattttataaaagttctccagcagcatttcaagggttgtttatgttcagtttgtccaattggattcttaaccgtatcagcggatgcttgatttgtactttctccgcctgtccgtttacaaagccggacaaggtgaataccgtctttccaaatcctttgccactgattctttgctcaaaagtactacttttctttttaatacgtgctttttcactctttagaaatagatttttgaaatcagtttccagtattttcagcatctttttcttcctcatcggttcaatgcaactgtttactatgaaggtgtcgcagtgcagggagaagtcaaaaaggctgaggccaaagtaagtggatcccaggatacggatttcgttatcaggcatttggcggacaatgagcattccgctgaaatgatgtttcatgaaatccagttgcaagttgtacttttgcgactgtgcttctgcctgcaggatgggaggcagtgccgtagcttcccctgtcacccggtgtgagcaggagagcaggataaacagcaacagcagccagctagcgtatcgtaaactttgcctcatctttcaaagaattgaatttcttgtccgagaattcgtattcggtatagttggttgcggtttccgataaacgtagtttgtggacagacatgtcttttttgtctaaataaatttgaatctggttgatatatgcctgtatcgctttgctgacgggcttgatttgaatgagatagtaatgggcgtcttcaaaatattccaaagcatagccgggcgacatgttggacaggtcgcccaccatgcaggcggtaagcatatcctgcatttggttcatcatcttattggagtgaaggtccatgatgcttttctttccgtccgatactattttcagttggttgttgttgatcacgataaggtagttcatgggctgtgcgtagtccatgcatatcttattgctctttttataatagaactttcctttcgaggttattttctcatcgaatacatccagatattttatctgagtgaaattactttcgatggactctatatttttagcctcttgcagcagacgggcttcaaaatctttcagatcagtaagtttcttcatctgttgggcttgcatcggcaggactgtacagaacatcaagagcaaaagtattttcatgtaggtcatactttatagaggtttatccgtttgtaatgggaagcaaagatagtatattttgagaaaccattcatacctttatcgcttatttacgatttttacctgtttctacaatcgttcacatgggcaattataatgaataaaaaagttatatttctgcgttgcaatatttttttgttttatcacggcatgttattgttaatcaataatttatagtgacgaatcctcctgtgtccccctcgaaacggtttatccgttttccctgtcggagtcagtttggcagaaagcgtcattatgcaggatgaaggtctgttggaattcttgtaaggagaacggtaggatatgattttcacttaggtgaagatgggttttcacctgtgtgaagagctgttgtcaccagtgtgaaaccaccgtttcaaactggtgaagcaacagtatatatcggaagtttacacactgacatcctattaagttgaacgaaagtacagcatatcctgtcagatttaatctgatatctgcgcttctcttgcaaataacgggtgaatgttccactccatcgcttacataccggtttgggggtattacagacttttttacacggcaagttgttggtaatgagtggaatgaagtggcggaagaattttatgttttacgtaagacgaagttatctttttatcggtttgatcatgaagggtgaaccaggtctcgtttctggaacttggtgatgttgctgttgaaaatatagaagaaatttattttgtcatgtcctttatcagcctatctaacgctactaccgtatacccctctttttctataaagtccagaacttgtaccagcagcctgtcactatcgggcatccggtcatgtagcagaaggatggagcccggaacgagccgtttcttgatgtgtttgataattttttcaggagtgggttgctgagtgtccagtgtgcggatgttccaaccaatggggatgtatcccagcctgcgcactgctttagccagggtaggattggtcactccgaaaggcggccggaaccatcggaccggttggccggtcactttttccaattcttgctggcaggtaattaaatcatggcacatccgtttgaaggtatagagaggaaaatagccggaatgggagaaggaatgattcccgatacgatgtccttctttgatgatttgccggagcagttcttcattgccttttatcttgtttccgatgcaaaaaaagcaggccggtatgtgtttttctcttaacactttcagcactttgggggtctgtatcggatcgggcccgtcatcaaaagtgatggctatgattttctcttcggttttcttgcaacagaagacacgcatgtaaatacaggcacggatgctgtaagaagcgtaaaagaaataggccatgacgcttactatgatgactacagaaactaggatgtgcattgcttgattaagatgattgagtgatactttaataaatgatcttgtagagattattctaattgtttgtcattatctgtcagtattctgaactttttttcggtatcaatcgtattcaagtgtgctaattgctctttggccatctgccgaagatgagtaaaccttttagacttgtccaccttacgcttgattaactctgcattgaaggattccatattcgataatacgactaattcatttatgcttgctacatctctgatattgatattcttatctgcgtattgtggatttgcttcacgccattgtcttgcggtacatccccataatgcgagatttaacaaatcagcttcatcggcataaacaagtttttgattgaaatcttctactttaggtataataaagtctttgattgcatccgtatgtatggaataatttactttactaagtattctttttacgttccattcacttaataaagggtgtgattctgcttctttaagtctttggtattctttgatgagatatagtttaaattcagggctgagccaagtcccgaattcaaaagctatgtctttatgggcaaaagttcccccatatcgcccgggcttggatataatccctattgctttagttttttctatccattgtttgggggttagggtgaaactgtttgttccactctccattttaaaagcatcgaattcgatgcctttaaaatttggattatttagtttttcccataaccctagaaaatcaatcgtactacgtagacgcatccagttttgtataatgtagttagtacgttctctgtctttgaaatgtgccatgtctgtcaggcagatataatcattattatcaggtcttacagatatggatatatcaatattcgtaacagttattttcttcattatttctactacttttattttatgagggataaagttaagcattattcctgttttcagtatcttaaaagcatctttttaataggccatgacgcttactatgatgactacagaaactaggatgtgcatcgcttgattaagatgattgagtgattgataccttgatattggttataaatcaatgcgtaacgggatgaagcttcttctttcaaggcttttgccgccatccagagagcataggatgaagcagtctgatattctccgcattgttctttaaaactgctatgcagggcatgagggaacagactgtgttccagatccgtataaacggcatctgttgcttcctgcccgttcttgccactgataaaccagtcaatgtcttcgggtgcaagcccgtgagattttagaaaatgatgcatcctgttactgatttccggagcactcatccgggtgataaaagtatctacccctttcagttcggcaaaagtctgttcctctttttgtgcgcttaacaggaaaaattgtgctccctcaccggctgtcgttcctttcaacagtcctaaacgctgctgaatgatatggctggtaggggttatttcatccatagcacctgccagtacatgctgtttgccttcggcaatgcttatgatgccatctatcagagcactttcaaaacttaaaccacggtgtacatacgtaacattataagcatgtattttgagtagcaaagctagctgtgcacccaccgtattaaaggtggactgaatgaaagcggtgggattgagcatctgttcccggttgtccatcaaggcgttcataaacttttccgtatcggccagacaacccagtcctgtagcggtgataatggcatctaccttttccgacgggatatctttcagacattccagtccgcaggctactcccatcttgatcatgcggctcatgcgcctccgcagattggcgttggtgatcatttctttataatcaggttcctgtgcggagaaataaggcttttcatttctgctttccgcatggatagaggcgatacggttgatatatactgggcacatacgctattgggttagagtggaaaatacgagagatgagttgttgccgccgaatccgaaggagttggataatacatgccgtatgggaagtcccgaccggaaaaccgtttcaggaatgaggccgctttcttcatcggacagatggaagttcagattagggtaaatcagtccgtgacggatggagagtacggaatatacggcttctattccttccgaggctcccagggtgtgcccgatgaaagccttgaccgaactgaaaggaggaatacgggtatcgaagatacgccggatggctttcccttcggaagcgtcgttgctgggagtgcctgtaccatgtacattgatatagtctatggctccggctgtcagcccggcagaggctatggcctgactcatggaaaggaaaggcccgtctccgtcgggggaacttcctgtctggtggtaggcttcattggcattggcgtaaccgctgagttcgcaataaggagctttagtaagggatttatcagattgaagaacaaggtatccggctccttctcccaggtttagtccggcacgtgtgcggtcgaaaggacggcagtgctctttgtccagtatcatcaatgaattgaaaccgttgagcgtgaaacggcataaggcatccgttccgcctacaaggacagcgtccagcagaccatgccggatgaggcgtgcccctaacataatggcatttgcggcggaagaacaggcggtgctgagggtggtcaccgttcctttcactcccaaataagcggctatcatttcggtactggacccacagtcatgggagataatgtcacgtaatctcccttttcggttatcttcccggaaagaggcataaaaccgctcgcttgcatccattcctccgatggaagtggaagaaatgagcccgatacggggagaagtgaaatcgagttccgcatcacgggccgctccttgggctgcccacaagcccagcaaggctgtacgtgaatacgtcttgccggatggaagggacaggagtttctttaattcttcattgctctgttttacttcggacacgggtacgtcaagtgcggtggggaaaagggtgattttccccataccgtgtttcccggcttttaaggaatccaggttttcttccactcctttccctatgcccgaaatcactcccagaccggtgacatagatcttcctcatttctgatgggcggtgatgtagtctgccagggtacgtaccgaatagaatatttccttgcctttggcaggattctctatcttgattccataattcctttccagaatcaggataatctctaatgcgtcaatcgagtcaaggcccagaccgtcatctccgaataaaggtgcttcactgtcaatgtcctccggagtgatttcttccagattcaatgcttctattaattcaactttcagtttatcaatcaattcttccatattctttattgtttttcaatcagtttaaatactgctttataggtgttcttccataattcacaccacccgatgatacaatagttcagtttccctttttgcatgactatacgtgcgtatctttccagtttttccggctgataggcttcagtgatgaaaaaggtgttttccccttgtatcttgtggcggatgcaaatctcgccggacactacattgggtagtgtgtaaacaaatacagccggactggctgcctggtctccttcccggtctatcagttgctggtgtctgatgtccgtatgcagagaggaagcggcattggcaagtaacatccccatttccagtggagcgaatgtcttaccttccagcaagtattcggcggccacatatcccaatttgcaaaggtcatccattttatagaatttcaggttgtttccgcctgtttttttataggtatcacgtataaatgtgccgaaatccggttcttcggaatgaaaaataagttcgttgtttatgaagacagaactgttttcaatacgaacctcccgtgtacatcggatttcgggcaaggtgttgtcctcatctttgaacggagtatattccggtaaagataagacaatggctgcgttgcatccgccgaatcccgaagcggtttttacgcaatgtttcatcgggatgctccggtgggtggcatagaccggtatcggcataggaactcccggcgtttcgtaacccggagtgccgaacaggatgccttgtttcagttcgtgcatacagacaatgctttcaatgattcccgatgctcccaaggtatggccgaaatagggcttcaaactatggacgggcacttgttccagatgagccagtgtgagggctttggattccatttcgtcattgtatacggtagcagtgccgtgagcattcacaaaactgatatcctgaggggctgtccctgcttcctgcatggcttggcggatggcgaaatagagtccgtctcccgtgcgggaaggaccggagatgtggttggcatcgttactgacggctcctcccgaaaggataacatgttcttctgttccttctgaactgagcaatacggctccgcaggcctctcccaagttcaatccgtcacggctgctgtcatacggacggcatgggcgggagctgagagaccggaaagacccgaaaccgctggtgatgaaatgagagagaaggtcacctcccgctacgattacccggcggtagataccgttctctatcatgcgttttcctgctatgagggctgacactcctgaaatgcaggcattggaaatgacatgcacccgttcctcggcatggaaataaccggcaatgttttctgccattttccaaagaaagaccgcttcatcgggatgttccgtatgacgggccagtaaatcgatgttccctttggtggtggagaggatgagtccgcaggttttgtcttccaaagtttgtccggactgacggatgagttcgttgatagtcagtatgaacagttgttccatccggggatagccacttactcctatggcttccgcctgttgttgcaatctctcttgcgagagagtggctgccaataggggagtgtccgcaatccgtttgtccgtctgcagggtgataccgctgtgatagctccggatggcttccagattttcctgtgtgccgaaacccagcgcgctgatcagggtatcatgggtgatataggtagtcagatgatgttccatttctttttccactctatgtaaaaggcaggattaaccagttccagttctctatttgtattcaggaatacctgtgtagtggttcctgttgccacaatgttttggtccgatgcccggtagatggtgtattcaaaaagaattttggcggcatcactgtggataaaccgtgtctcgacaatcgcttcctcgccaaaagacagcggttgtttgaactggcaggtcaggtctacgataggaactacatatccttcccggtagatgctcatatagtccagaccgtatcgctttccgaaagcttcgcgtccgtcttcgaaataacgcacatattctccatgccatactatctgcatggaatctatctcactgaagcggactttgatggtggtccggtccgtcagtgccgcctgatgtggacttgtttttcgtttcattctttcttcagatatattttcatccggcattcggccagcaattcatcgttttcttttacctcggcggtaatcagggtgatatcaaatacttcctgaacgatggttataccggtatatagttctgctccggcagaaggaagacggaatagtttcatcttttctaccgaaccgataaaacctaatggtacaggttctttccgcagcatatagatataacctacacgtgccgccgccgactgggcgatgtgctctatgattcccgtttcctgtaatacaccgtcccggcagaacaggttgtcggtagtgacggtcagccctgaccaggatgtattttcttctatcccatagaagcggtctatcattaccatgggcgggcgttggggaatcagccggaacagctcttctccctgacagatgatttctttgctgctcatttcagtctgcattgcaggatactgtgtcccagtcctatgttatcttgaatttcttccacttccaatccggcattttcaatgcagcggatcaggtcatccgaatggaacatcttactgttgccgttggccattgctgtaaagtagaggctgatttgtgtcaggcaataagatgctgtttcataccgttggcgatcccataatgtttccataatatagactttgctgtctttgccgatggattgtgccacacgggtcaggatgctgatgacttcttcttccgagaagcagtccagaaactggctcatccatacagcgtcaaaacccgtgggaaagggcacgtcccgatccagcagattggcgccgtgaccgtgtatgcgttcactaccggacaaaccggccgtttgctttctcatcatttccagttgttgaggcaggtccacgatggttacttccacttccttattatattgtacgcattgtgtggcccatctgccggtattcccgccaatatcgagcaagcgtttcgggtgatggctgaacacgatttccaacgctttgccgaatgactggtccgaatagaaatgatcaaagccgaaccagcttttctgtacctgttccggcaattgggacagaccttcgtaaatggtaggccattctccgaatactttcaatccttccggacgcccgtttaaaagagcttcttccaaatggaacaagccttgatagttcacatcgtgattgaattccatattgacacgagccattttatcgttcagcagaaaccagcctgccttggccagtacataacggtcttcttccaacaggatggttccgatggtcagcgatgcttccagtaatacttgtgccgcatagcgtgtcagtccggtctgcccgctgatttcttgcagcgtatatccttcccgtttgccggacaataattggaaaattccgaatttcaacatcaggcgcgatacttggaataccacaggaccgaaagctatctcttgtgccagtctttgcgcttcggcagccgtacattgttcttttgtatatcttttatgcatcataccagatttatttttatgtccagaacgggtagtaattgaaccattgttccggatactgccggacaatcttttccagcgtttgtgtatattgctccaataatgcctgttcggcccgtttctctttcgtccgtactactgtctcggctataaagaaatggaaacgatacgttctttgggcttcacgcatggcaaaatagaatacgacgggtacttttaacttcgaagccagcaggaaagggcccatcggaaatttggcttcttttcccatgaaagaagtcgtgagtaatttctctttattcagatagcggtctccctgaaagcagacatactcccggcggtccagcgcttccgtgatgcggaatacatgtgtcaggctgtcttcattcaccggaattattttgtagtctcgcgtagaggcgttcttttccaaaatctcctttatccgttcgtgttcggcgtcaaacatgacgatattgatctttttgccatattcatcgaagaaaggagcgcctatttcccagttgcccacatgggcgccaatcataattactccggtgtttccgtttagtacgtctaaaaatgcctgatagttctcaaacttgaaatgatacttgccggtcattccgttgccgatggccactttgtcaatcaatatttgtcccagccggtaatagtttttcaggagcagtgcgacggatttcagccgtccgtatttcagcctgttccgtgcgtaactccaagtattgcccgttgctttcggtgcgaaaggtatgaagtagaggacgaccaatgccaggaagccgtaggccgcagttatccccagacagcggatcatgtagataaagaacatgtatccgaatatgcctcctcttgtcttacctttccatgtttcggacatcagtcttctttttgcatatgtgaaattaccagattatagaaatcctggaaggttttgataccggcaaaatctttggctgtaacggtgaaaccgaaattcttgtcaatcagtactaccatatccaccaggtcaaggctatccaattccaaggtttgcatcaagggtgcgtccggttggatctgttctacatcaatctcaaattcttcggccagggtggttctgatcttttcgatgatttcttcgttggtcataaatttatatattggtttgaattaattgttttctttaaatttacggataatcagtgaggaattggttcctccgaatccgaatgagttggacaagaaggtgtcaaattccgtttctatcctccgggaggggatgttcagcagagcagaggcttcatcgggttcttcaaaattgagattaggagcgataaatccgttattcatcatcaagatggaataaatgacttcactggcgcctgccatccacatctcatgtccggtttgtgacttggtggatgtgacatagggccgatggtttccaaacacttccgctatggcttttgcctcattcaaatctcccacggggggtggaagtggcgtgtgcattgatatattggatttcttccaagggaatgcccgcatcgttgattgccatctgtaaagagcgtctgggaccgtccacattcggtacggaaatatgatctccgttggatgaaaaaccgtatcctatgacttctgccagaatagtagctccgcgccttacggctgattcataactttcgagtaccaggctggcgcctcctccgctgggtaccaaaccgtcccgtcccttgtcaaaggggcgcgatgccttttccggttcgtcctcacgggtggagaacgcgcccaatccgtcgaaactacccacggagtaaggatttacctcttgtgcccctccgcacagaatgcaatcctgaagtcctgatttaataagaagatacgccatgccgatggcgtgtgaaccgctggcacaagctcccgatatggtaaaattaattcccttcaaatggaaaataaccgaaaggttcatggtaatcgtagagttcatggactggaagatagaaccggagcccaccatagccgtattcttcttggcacgaatgacatcaatggcctcgattaccggagcggcgctactgtcatttccatacaatatgcctacttcatgatccaataaaaactcctcgtctatttgtgcctgacggaatgcctccaaggtagccatataggcatattctccctgttcggcgaggctatgtctctttttgcggtccaataacttctttaaatcaggacgttcgacaagtcctgtcaatgcggaaaaataccccatctctttacgtgccggatcgatgccgatgccggaacgcccttggaacaaagagtctttcacctcatcttggttcttgcctatgcacgaataaatacccatgcctgtaatcactactcttctcatcttctgcttatgtatagattcctccattgatggaaattacttctccggtgatataggaggcttgttccgatgccaggaagcctaccagtgcggctacttctccgggttcgccgaaccgtcctgccggtatctgttttttccattcattttcatcaatgccgttggtcatatccgtgcggataaatcccggtgctacggcgttcaccgtcacgtgttttctggccacttcctgtgccagtgctttggtggcggctatcattccgcctttggctgccgaatagttggtttgtcccggcattcctttgatacccgacagggaaacgatgttgatgatacgtccgaatcgctttaccagcatatttttcagcaagggttgggtgacgttaaagaaaccgttcaggctgatatccaacacccggctccattcatcctgttccatccacagcatcaggttatcacggcgtataccggcattgttcaccagtacctcaatgtaggtatcgggatgcttctccatccagccgttcagtgcggcgtgtgtggctactgcgtctgtcacgtcaaatttcatcagttcgccgtccgagccttgttcccgtatctgttgcagggtggcttcggcttccgtatcgttgctttggtagtttatcagtatatgatatcccatttcggccagtttcagacatacagcccgtccgatgccccggcttcctcctgttactaatgcgtatttcatttttcttgaaacctcccttttttaagatataccatcattctttctatctctttatatttaggcgtatcttcccggaatacaggaaaaaatgctcgtatctctttatatacttgttgtgaccgggggcttagccgaccggctatttccaaacagtctacagcttgtacaatacccatcatcaggatagccatcacctgataagcattttctatgactgtttttgccagtagtgcggaattggttcccatgcttacaatatcctgattgtcattgttgttggggatgctatgcacatacatcggattggacaaagtctggcactccgctgtggtagaagtcgcggtaaattgtgacgcctgcaaaccatagttcaatcccagcactcccatattgacaaaggggggcagaatgccgttgatgcggtcgtgaaacaagtaattgatctgccgttcggcaagcatggccagtttggtgaccgctattttcagtttatccatttcaaaagaaacgtaatctccgtgaaaattaccgccatgatacacgttttgcgtgtcggggtccactatcgggttgtcacaggctgaatttatttcgtttatcaatactttttcggcattgagcaattcatcataaaccggtcctagaatctgtgggatgcagcgcaacgaataatagggttgaaccttatgggtgaagattttctcttcgtgttttccgttgtaaagttcattctctcttttgcgtacacattggctgccttccacccattggcgcatcatgcgggctatctcttgctgtccttcatgccgtttggcttcgttcagcggttcggacatgaaatcatcgtacgaggcggcaatttcattcatcatgaccgatgcgcctactgcccaatgcatcagttggcgggcataaatcaggttgacaatgcctatacctgtcattaccgaagtgccgttggtcactgaaagcccttcgcggatatgcattttgaagggttgcaatccgttttccgccaaaacggatgccgtatctcttttcttgccttggtaaaagacctctccttctccaatcagggtgagggcgatatgggcaagctgtaccaaatcgccactggcccctacactgccgtgttcgggtacgtatggagtaatcccccggttgataaactcggtaatgagcaatgccagttctttatgtatgccggattttccttgcagaaaagtatagagacgcgctatcatggcagctttgacatagagttccggaaggggttgccctgctccggtggcatggctgcggatgatattatactgtaattgtgacaaggattcatcttcaatacggtattgggccatcggtccaaagccggtattgatgccatagatgatcttgtcgttggagaatgttttcagaaaatggaaactctcttccaatttttgcatacattggtcggagagtgtcagtggctcttcttcaaacaaaatcttatacagggacgctaaagttatcttattctcagctagcattggattggtgtgataagcagttttgtataatttccgcaaaaatagttatttaaaaataagtattaccatccgaagggagatttttcagttttgatggttatctgaaaggttcaccacagattatacaaataaacgcagatgcttcttaagtcattgattgtcaggtgggtaatctgtgtgaatctgtatagtctgtggtgaaaaatatagtgtcgctctatgtatcctatttattcagtttccatgtgaaaccgtctttggtatctttcacttcaaagccaagagcggccagctcatcacggattttatcgcttgtagcccagtctttattggctttggctttcatacgttgttccagcagcatatctactactttgccgtatgcctcttcacgtgcctcgttattggcggcttcttctttcagacccaggatttcgtacataaagagatggaacacacttttcagttcttccagatcttctgcggaaatagtggctttcttgtccagaaccgtattaatcatacgggcgccgtcaaacagatgggcaatgacaatcggtgagttcaagtcatcattcatggctgtataacacttttcacgcaagtcttttaccccctctatgccggtggtttgtgttgccggagtgatgcgttcaagacctttcacagcttctgtcagccgttccaatcctttttcggctgcttgtaatgcttcgttactgaagtccactgtactgcggtaatgtgcctgaaggatgaagaaacggatggtcatggggctgtaggcttgggtcagtaacttgtgggtaccgtggaagaactcatccaagttaatgaagttgccgtatgattttcccatcttctgtccattaatggtaatcatgttgttgtgcatccaatagtgaaccatgtcatctccttgtgaagccacgctttgtgcgatttcacattcgtggtgtgggaaaattaagtccattccccctccgtgaatatcgaaatgctcgcccaggtatttcttacccattgcggtacattcacaatgccaaccggggaatccgttactccacgggctgggccagcgcatgatatgttcgggttgtgcacatttccacagggcgaaatcggcaggattgcgcttctcgctttgaccgtccagttcgcgggtggtgtttagcacatcgtccaggttgcggccggacagtttgccgtaatgatggtctttgttgtattttgctacatcgaaataaacggaaccttcactttcataagcatagccgtttttcagaatttcttctaccagttctatctgttcaatgatatggcctgatgcatgtggctcgatactgggtggaagtacattcaaggcttccattgccttgtggtagcgattgaggtaatattgcactacttccatgggttccagttgctccagacgggcctttttggcgattttatcttcgccttcgtctgcatcgtgttccagatgaccgacatcggtaatgttacggacataacgtaccttgtatcccagatgggtaagataacggaacaggatatcgaacgtgatggcggggcgtgcgtgtcctaaatgggcatcgccatatacggtaggaccgcatacatacatacctacatgaggggcatgcaagggaacgaaaagttccttttgacggcttaatgtattgtaaatggttagtttattttccataattcattctattagaattgcaaagttataaattaaagtgtgtatttggctaataattaacaaaaaatctgatgctgatgtcctctgcttgtctacaaatggtgtttgttggtttaaaggatagagatttatggtaataaataaaagtaggttgtctttgaatgtaaaagaacagaatgatgattttttgtatggagattagggaacctaactctttttccttttcatgaaataggtttctcttgtttctgtttatgctctttaatctctgctattgatttgtaaaacaggaccactgcctcataaaccttggtgttgttttacggggcagtggtggtgtttctatatgaagtttgcgtgcggagcgggaatgtttatttggacttctttccccaatacgtcttgttgttggcatagccggcatagacgatggtatgggtgcgcggactggcttcccagtcggtttcgcgttgcagataaagttccactccgttgacagtcagaatctgttgggcggcatcatagctccacgtactgcctttccaggtaccttcggtgatagtgtggtcggcggcgagagtcattgttgctgaagttctctgctctccatatttgtatgtaaggtcgatgtgttcccaattgccgggcaattcttcttcggtgatggctaccttgggaacggctccgtagcgttcaggcattacgagaggccaaccgtctttcgtccagcggatgctgcgtacgtgccccatcatgatggcgttgctggcgttgatgcccggaacatccttaggcagacggccttgtgaggcgtagaaccagttgtctttgccatcgtcgaagatagcgcagtgggcgatgcctacccagccgtagcctttgctgaacttatagggatgagtcactatgggcagtgcatcggcaccggcggtcacgtctttgccgtcaatgcccacgtagggaccggtgatgcttttcgagcggaccacacgggtgttatagggcacgtcgagagcgtcgtaggccaggaagaggtagtagtagccatcgcggtaaatgacttcgggaccttcactggcttgccagcggttacctgtctggcgggtggcgatcaactgaccatactcggcaggtgcttggcctgtagcccaaggttggcccaaagtttcggcaggcttgcctgtttcgccatcgagcttgagagcggctatgccgctatgccatgaaccgtagaccaaccagtgctcgccttcgggcgtgatgacataagaggggtcgatggcattccatttataatagcaattggcccaatcatccggcttcacgttgaagttaagtcctttgtcggaagcattggtgatgacgtagcctttgtctacccatccgtcgttgttggagggatcgttgttttccatcaggccgataaaggcgcgctccgaccaggtgttggcaccgttgagtgtgccggggcagacaatggaatagtacatgcgatagaggccgttctttaccttgcgtactacgggagcccaatagccgaagtcattaacattaggattgatttcggcaagtcccatttcttttcgtatttcattgagcttgggcactacccattcgggcaggttcttcattgtaccgccgaggtattcccagttgacaaggtccttggagcgacgaccgtggaagtggccgcctgcggtgtggacgttgccgtatgaagcatccgtctgatacatgtaataataaccatcttcggccaatacaaccgaggggtcgtgtacgttggcaagattccattgagagcgtttgctccagtcacttatcgaggtatagtcatcggagtaggtgggggccacgtaattcttgagttcatcgtctaagcttaagctttctgtggtggccgtgaccacctctgaatagacataacggctgtcacagtagacgtatgcacggatatagtaggaggtaccggaggtcaaggttgagagggaggcactgaaattctcatcggcatccaccacgtggtctttgatagtcggtacggaagctgctgcactgtaacagaagcctttcttgactatttggttcagatcacctgtaaccgatgcggtgacggtcaacgaggtgggggtggttgtagttactttcggagtacttacagttgcataatagcggtctatatcttcgctgttgtcagaacaagcggttaaaacaaggaatattggtaagaacatccacaatggtaatagttttttcatctgttgatagtttaaagaccatgccgcttcttcctgaggaaaacggcatggcttgtgtgattactgattcggattagaagacgagatggccgccttcaatcgttaaagcgaagttcaagtcgttcatatccaatttgttgatccctaaatagtattgggcataggaagtacctgaagtgcctttcattactgcttgaatgtcggctgtaccattgccgcaattggtcacgtagacggtgactttggctccgttcatatcggcaagccaagtggcccagtcgccttgtgtaccgttgtgaacgaggctggcatttccatcgtatcctgcaccccatccatagttgtcggcgcgtaccactgcatattcggcaagatcggctttgcggagaacgatagcgaagttgctccagttattagcttggctggtgtaattggtgaagctgatggatctggtttcacctgccggcacgttgaaattgtcagaaaagacagtccaccaacccgttgaattgttttcggctcctatgataccggctgagttgctcacagtggcaaccacagattcggcaactttgacttctacggtagcggtaacttcgtcggcagtaatggttacggtctgcgtaccggctttggcaggaatggcagagaaatggagtttggcgttgtctactactcttgtgcttccgtcggcataagtagccgttacttccaatccttcgggaaggaatgccagcgtacggtcggtcatcgtttccgttgctgccgaagtataatagtaatactgcgtgtgcgcaggttgagccgtcacttggatggatacaatcttttccactacttcaaacgtagcattggccaccaccggctggttgcaattctcgcccttgaaggtcttgttgtagatgactaccagtgtcttcgtgcccagttcgttcatattggggatggcagtgaactggagttcttctgcggttacggtcttagtcaccccttcttcgaagctgacgatggcagtaatcccggccacggcttcttcgagtgaggtgccggcattgacctgatcgggtacattttgcagtaccatcgagagcggattcttgtcttcggcagaggtaaggccgccgataggaacgatgttcgattgcaagaagttgatgtaagagccttcgggtaccaggaagcagcggatgttggtattgctcgcgtctgcattcagattgggtaacttgtacggctgtttgtaggttttggttgccgaggcgttctggattttgatagagaaggcattttcattggtgcggtctacggtgagtgttactttgccgcccaatttctgtacagcttcgtccagattgtcaacgggtgacagcatcagcgtgctggatgtgtatttgaagaagagatgggaaccccattgggagttataggccaaagtatcgtttgtggtatcaaaacgataagcgccatattccgtgtatccttcacctccgcggtctgcgtcattggtaatgactagggcgaagtttttataataggtattgtcggcagggttgatgttgaggttgaacactccatgccacttctgaccatcgggcacgacgtaatacttggagaaagctgtccagaaaccggaggtgtagtccgcattaccgaaggagtagacatcttcctgcatgccctccagcacttcttcttccggatctttctttgaatttgctatggagtccactttctcggaaatccagtcaggggcgttaacatcatacagctcgccaccctcgcagcttggcaatgccatcaacccgaaggcgatggaacagcaagcgtatactaatttattgagtattctcattgtcttacattttaataggtttgtttatttgcttaagtcaaccaccggatgaacagtccatccgttctcactgaaataagtagagttgtccgtgctaaagttggcagagttaccacttaggttagggttcttgttcaacaactgttgtacgatgggcagaaattcgtgcccgggtaagtaggtgtcaaaagaactttttagttcggagtcggttgcgatatcgttgtagtctacaggatctttggttccggttacagaacggcgtacgacactgtgctccttaagttgttgcaaacgatcattcttatagaagaatccccagcggataagatcgaatccgcgtccgaactcacaaccaaattctttcggacgctccacattggcaatctgctcgaagagtttgtcggctgtagggaagtcagccagttccagatcgggcaagtcagcgcggttgcgtacttcgttaatccagtcgatggcctgttgtgtggggccgttgacttcgttttcacattcggcagcacggagcagcacgtcggagtagcgcatcagacgcaagttgattccatcgtgtaaacctgtaataacggtgctatagagtccggtacggaggtttgtgaacttggcgatgggtagaccaccgtatgtgttgttggttacgatgttgtcggtggctgtaagtttgctcgtataagctacattgccatattcaaagtcttcccaatcggattcgtaagtaccgatggtccagtacagacgcgggtcgagtttgccgtcagtagtacgttctgctttgaagagatggtagagccagggggaagccgaaatgtcggcccaaccgccataattgccgggagcgaagttactctcgatggccgaaccttgggtggcattcgggctggtgttcaccggagtccactcgtcgtcggttccttgtgattctaagtcaaggaattgcacttcgaaaaggctttccttgttgttctcataggcaggaccttcgcgaaagttgtcgccatagttatccatcagttcataagtaccatattttttgccgataatgtctttcagtacagtaagggcgtctttgaatttatggcgtaccatgagcgcacgggcatagtaaccggctgcggcaccacaggtggcacgtcctttttcccattcgccaccttgatctcgtgagggtaacaattccatggcttctttgaaatcactttccacttggtccagcacggcatcataggtgctgttgccggtataaagcccgtccaatgaagagtaggtggcataatctgtgatgaggggcgggttctggtaataaccaaccagattgtagtatgacagaccgcgcaggaagagcacttgtcctttgatgcgtttcattttttcggaaagctggctgttgtcttcatcgcaacgggaaatggcaaaattacatacattaacggtgtagtaccattcgcgccagggccaccacgtgatgtccgaggttacttccgcattcaggtcatcgaaaggcagataccatacttgtgatgaattccaggcttcatcgccacgacacacatcaatggtgtagcctacacgggcgtaagaaccttccatacggatatggttataggcggcaataacgctctcttccaaatcatcggcattgaaaccgaatgtgtttgaggtttgctggttgggatttaacagctccaaattatcattgcaagaagtcaatgtgcctaatcccaaaaagagaaccaatgcatatttattgagtttcatattgttatgtttttagtgattagaaagtgaaatgaacgccacacatgaaagtacgtgcggtaggataagaacagaagttatatcccggtgtgaaggtacctcctgcatagtccacattgtaacctttgtagccggtaaaggtgtgcaggttctgtgccgacacgtagaaacgtacatccgatacgtatttgccaaaccattcgttggggaagttgtagcccagttctatattggcaattttccaataagctgcgttctgaattttgcggtcgctgaagagatcgttccaggccaggctggcactgttggtgacataggtacgtggtacgctggaaagataggtgctgccgtcttcgctgaagcgattggcgtcgagcatggctacgtctttgttgccccagccatagcaagagttcagagagttgtggatgtcgtcgctaacgtgatagttgagtgcaccgaacgtagcgatgctcaggtcgaaacgtttgtattcgaagcgggcgttcaaaccgaaattgatcttaggcataccgctgcccaatactacctggtcattggcatctacctttccgtcaggctttccgtcgggaccgcttacgtccttatagaggcagtcaccaatttgggcgccttcttgtgtggcatggttgtccaagtcagcttgtgtgcgggcgatgccatcataaacccatccgtagaatttgccgatctcttcacctacgttggtgatgtaggcgccggagatgtatgaatcggtaccgaagcccaatgaggttacgcggttacggacagtacttaagttagccgacacttcatacttgaagtcgtggtctcggttgcggtaagtagctgcaaattcgaaacctgaattgttcatcgaagcggcgttcattgttacggtggtattggatacaccggcttgttcgggaacgggaacagcataaagcaggtcttcactggtgttcttgtaccattcggcagtgaattccagacggttgttgaacaaggcgaggtcgatacccacgttgtagcttttcttcttttcccaagaaaggttgttgtctacgaaagtggaaatagcagaaccggtgatgggcgtgttgccaaagctataagtcatgttattacgtgccattacagcctgatacatgtattcaccaatgttttcgttaccgagctcgccatagctggcacgtaccttgaacatgttgacaatgtttctgttgaaggggaagaaagactccttgtcgaaacgccatcccacagaaacagaagggaaggtgccccaacggatattttgggacaagcgggaactgccgtcgcggcgcacggttgccgagaacagataacgctcgtcgtagttgtagttgatacgcccgatgtaggataggagggtgtgtttgtattcgaagctttcagcgtaagtgttggcggcattctggagttgcaggaagtaaggctcggtgaagttgacgccccagcctgtcagcaagtcggtgttttcttcttcgtaagtctggccggctaccaggttaaaatggtgtttgccgacggtggcatcataagtcagcacgttttcaatcaaagcatcggcataagagcgggtagctttggtgagacgttcgttgcttttggccagatagacacggttgctctgtacccatgcaggaatccaggtgaagtccttgcaatgggttttgctgtaagagagattgactttatagttgagcttgtggtttttgctgtcaataccgatcattttcaggagatccacatcggcagaggctgttcctacaaagcggtctacacgggtattgcgctttaacaggttattgaccagcaaggggttggaagctgaaatgtcaccatgtacggtgtcgtagtaaacaccataaccataagagtcatagttgaagttattggcgatccctaccagattgtcaagtacccaagtagagttgtcgtaggctttgatggtgggttgcatcagcaaagtaccacgcagtatgttggttacgtctccatacagaccttgaacgtattcggaagcgtttgacaaacccatgttgtcttgatcggagtgagagtaaaccaggctggtatggaacttgatgaatttggtgtccatcgtgttgttgacacgcgccgtgtaacgttcgtagttgggaccggcgccttccagtgtacctttctggttgtagtaatctaatgaaacgttataagtattgtgggcaccgccaccggagaggttcacattgtgattttgacggatacctgttttgaacacttctttgaaccagttggtattggtgttatcctggaaatgatattttccggtggtactgtccagcttgtaaccgccgggcagcggagtgttggagttggcgcatgcctgaccgatgtactggctgtattggtcggcatccattacgtcatagacactactgggaatgtagtccatacctacgtacccattgtagtctactttcagcggttggtctttctgaccgcgtttggtagtgatgatgaccacaccgttggctgcacgcgaaccgtaaatggcagcagccgatgcatccttcagaatttggatggtttcaatatcgtttgaagagaaatcgcggatggaagtacccatggggacaccatcgataacataaagaggagaagtgtcaccaaaagatccgacgccacggatacggacggtagggtcggcaccgggctgcccgtcggaagtgacttgtacgcctgatactttaccttcgagcatggtggagatattggaatgggatgtctgtttcaaggcttccgtgtctactacagctacagaaccggtcaaatcggatttcttttgtgtgccataacctatgacaacaacttgttccagcatctgattgtcgggttgcaattggatggcttcaatgatagcgcggttacgaacagctacttcgcgttccttgtagcctacatagcttatcgaaaggatagcgtttccggcaacctccagttggaagtttccgtccacatcggtaatggttccaccttgtcctcctttaattctgacagtagctccagtcaagggctcaccttgttcatcgataacttgaccgcgaaccttgatagccggagattgtgccacggtagctatagcaggtgtgggatacaccatcatgccacccatagcacacagactaagcattacggaaaataataaatgtttcctcatttttttaagtattaaattagtagattaaattgttgctgatgtattgaattgagatgttggattattgtacaatccaatgttgaatactctaggtagacaaaccacagagtttataaatatgctggagctattcttcataatatttaagattaggattagactttaaaagcagggttctcttccgaaagattgagcaccgattgcatgacaaaaatataatttacaccgtaaacaggggtggacaaacggttttatagggtggacgaatggataatggaaaaaatgtatttattccgcttatagtttgcgtcttttggaggtggtgagataggcttaggagaaggctttttttatataaagtcatgtagccggacaacctggtgaaggactgtccggctacatgagggataaaatacaaataaaattctctgaaaggaattatttcacaagtaaaaatcctccttccgcctgcatcgtaatgctgacttcatcattcttttttaatgttatctcttcagcgtgaggatttagttttttatcgtcctgataaagcatcactttatctcctttagtacacatgggaaggttcaactttaatttcagcggttctttttgtgcattgattccggctatgtaccatttatcggcatgccgacgtgccagtactacgtatttgcccggatagccgtcaatgaatcttgtttcgtcccatgtggtgggaacttgcttcatgaaatccaaacaaacttggggggcatcggtcaggttattaggcgccaacgcaaaattctgaataggattttggaataaaacggctgttgccagttggaatacatcagtggtcttgcgtatgcttccgccgtcattgttgcggttgaggcgtttgttgaggaatgtgccaccaaactccatgcaaccgatggtgttgcggataaatggatgcagacaggcattaaatgcttcttcatcgcaaaaatgttgttggaaaatcaggttctccgatgcgagcacggcttcgcttcctacataattaggatacatacgctcccatccgcgaggaagggtacagccgtggaaaataaccatcagtccattatcatccgcatcgctcaggatggcttcgtacagacgcatggtttcctgcttgtcacctccgaagaagtctactttgattccttttactcctatattatgcagccatttcatttcctttttacggataatgggattatccatgtaattggtaggaccttgtacgatatcattccagtagccgctggaactataccataaaaatacatctacatttttactgtgtgcatagtctatgaagtctttcatacgttcacggccgatgttggtatcccaccagttgtctatcaatacatattcatatcccatggcggcagcaagatctacatattttttctgatcgtcgaaattgatgctgccatcttgccaaagtatccagctccaggttccgcgtcccattttgtatgtatgctccgttgggtaaagaggttccacgacatcccatggaatcgttgtttctacaatgggcttcaggttttcgcctacagtaatagtacgccacggggtggagccgggcaatgcaagaccgggagatgccgtaccgttaccgttgttttcttcgggcatggggaaagcgatggtataaagtccgtcggcggtggcatcgctcaggtgtgaaccacagtatttgctgtctactccggtttcactgataagtgcccagccattttctcctacatggaacagacaaggaaatgtgtaaccgtgcccatattgtgaacgtacattcataggagcgtcagccttatattcttcctcataactgggcttggtacgtttccaacctatcatggcgtcactttgcgggcacaggaaagtagtggtgaaggaggggaagtcaaaaccggtagtctctttttctatcacgatgcttcccgtatcgccatatttgggcatttcgtagcggaaagcaatatcgttgttgcttacgcggaatattatatttatatttttcttttctttgttggtaaaggtgcatgtaagttcattggcttgataatgaatttgtgattgtttgatacggtcttgcgtataggttttatctattttattctctttttgtccggtgaaagtcatatcccggctgaagtcgcccacattggcaatgaaacctaaaggtgaatcttccaggatggtcttgtccttataggtaacggaataaacggggataccctgttttacggatacatttactttcaaaaaggaatcgggtcctgtaactgtagcttgttgggcaaaagctgacattgtagtgatggcaagcagccaagtcataaattgttttttcatgggtattaaatatgctattataatgtagagcaaagataatttatttagcgagacgagagcgtagaaaaacggagcatttatggtatacaatccgttcattttacgctctggaataagtcagtcggttccattctccatcatcgaactgggtgttgttccgaaatgttttgtaaagcagcgtgtgaagtatttgggatcattgaatcctacttcgtatgctatctcagatatattcatattgtgcgtcagccggttacggataataagttcccgcgcaagattcagccggtagttacgcatgaattgtccggcagactgtcctgtcagattttgcatttttttgttcatcaaacttttgcttacccccattgcttcgatgaaatcgcttatttcgtaataggagttcttatagttttctttcacaatctgcatcgccttgtccaggaatttcttgtcactggattctttttcgatattcagtgcatccacgtccatactgtatgagaacttttgttggaaacgtttgcggttttccagtatattggatatccgggccagcagcaaagtatcatcaaatggtttcagcaggtattcgtctacacctatacggaagctttcgatgcgcgattcgttggatgttttggctgtgagcatcagaaaggggatatgtgagatgacaaaattggattttacccggcgggacagttccataccatccatgacaggcatcatcaggtcgctaacaataaaatccacgttctgggattggagcacagtcaatgcttcttcaccttgggatgcttcgagcacgttataatattcggccagaatggaacggatatagtcgcgcatatctttgttgtcttctactaccagaatcgtcagttttccattggtggcaggttgcaaggccagcggagattctaccggttctttaacttgctctgttggtgcgggcagactgtctgcatcggcatattgcaaagggagtaaaatacggaaagaacatcctttgctctgattattcttggcacaaattgaacctccatgcaactggacaattcgtttgcatagatagaggccgattccggtcccgctttgtccgttgatagaggaatgcgtcttgttttgtgattggtagaagcggttgaatactttgtctatctcttcttcgggcagtcctggccccgtatcccggatacagatgaacaacttttcctgctcttcctggcggaagggggtggcatagatggtaatttgtcctcctttgggggtaaatttcaaagcatttcctatcaaattgacaatcactttatgcatggcatcctcatcgtacatgatttcacatgaaggaaggcggaaacgacgttcgatggttattcctctttcggatgcatatgcgtcgaagggaaccagcagttcattgagtaacttggcaaagttgcccgagttgcggacaatttccattttccctgattctactttgcggaagtccattaattggttgaccagtgagagcagatattttgagttgcgctccacaaaatgtaattgttcaatgacttgaggattgtagcttagtttcaatgccctttctataggtcctacgattaatgtcaacggagtacggaattcatgggtgatattggtgaagaaggcgagtttgtcaaccgtcaattcctgtactttctttgacatttgtatcagttgtcctttttgtttggttattttttcgttttgctgtttcaatagttggttttgacgatagagctcgcttgcctgagtggaaagcagttttttttgttcttccagttcacgggtacgttcctctactttgatgtggagtatttcttgttgttcttttaacgaacgaagcctccatgataataccttatatataaggaaagatagaagaaccaatatggacagaatgaaccagatggttttatagaaataaggtgatacggcaatgtggagttctgccatttcttccagccattgtttgccgtcgggggcataacgcagttcgaaagtatagttgccgggacgcaggttggtataggcggcttgtcgcctgttggccggcacttttatccatttgtcgtcaaatccttttaagcggtaataataattggcgaatgtcgatgcatcataatccagtgcggcaaattcaatatagagagatttgtcgcgttcgtgtaactgtagggtgccgtttgtgtacaatcgttcttcattggccacacgaacatgggtgaatgccagaggaacagcctccttgggatttgtgtctatgaccggtttgactacagacagccctttagtacttcctacatacaaatctccattggcggcacggcatattgcgttccaatagaactggttggataatagtccgtctttccgggtatagttgaagaagctgttgttgttaggattgaagcgggagagtccgtcggtggtggtaatccaaagatacccttctttatcttccgatatgcagcggacactgttgtttatcagtccgtcttcggtggtgaaggagcggaaggtatattctccgttttctgttggtgaggatttgtagaaaccatatccgttgctgcctatccatagggttccgtctttagactgggtgatgtaggttaccctttccttcaactttgattccggttcgtccagcttgatcctccagagttgataaatcagtctgggggctttcaaactgcttagatctattcggcaaagtccttctgtaagtcccagccacaggtggttatccttatctatatagtatcctgtacagccttcaattccacctaggttcatacccttgaatggttcggtgagcgtttgtgttttcaagtcgtaaacatagatattggtactggttcccacccagatggcattattcaagtggtcatagcagatacttccggcccatccccatgagaagtctccgtattcgggtatttctatgtggtggaattgtttgttctgcggatttttcatgtctatccatcctatgcctcctccccaggttcctatccagagccttccatcgttatcgctggtaaaacaactgacggtattatggcttaggtgggcgggtgcatcagtggtatagtgttcaaaagtgttgctgccgggagcccgccggtttaaacctccttctacggttcctacccataaaacacccgacgggtcttcataaatggcattgacgggattttgggaaagacttccgggaatggtgggaatatgataatagttttgtaccaacagcatccggcggctcatcttgttcagccctcccacttcggttcctacccagataatgtcaccatcggtcagcagacagtttacgaagtcacagttcaatgtgttttgtacgatttctccttctccggtatctttatttatccgctcaaaattgtctgtcaacgcattataaaggtttataccttttagggtggcgaccagcatggtatgttctcctgtttctgctatgtctgtgataaagttttgggaaagcgagttgttgtcattcggatcgtacatataatgcttcatcagttccgtatccatattgtatcggaaaaggccttgtgcgctgccaatccaaatttcattttctttccggcagattacttgtatggacacaccgggtaattgcagggcagatgaaatgaatgtgggttcctgtacttccatagccgattctttgatgcggtagataccgtctttgtagtttatccaaagatagtcttccacctcacaaatagtccggatggattctcctgccggcacttcgcatattttaatgatctgtcttatatttccttgtttgtcaaaggtaattttgaataaattgttttccgaacaaacccaaatatttcccgctttgctatggagaatgagatgggaggggcggttgcacagtgaaataagtttgtctttcgtatcagcgacttgtacagtctgcatggtttgtatatccaatatgtcaatacccatttcactgacagcccaaatacgcttgaagttatcctcacacagtttgtttatgaagttgcttcgtagtttggtgtgggtgcttcccatattgaaggcggtaaattcataaccgtcataacgggcgattccttccccacgggtggcaatccataaaaagccctggctgtctttcaatatatcgtccacgaagttgtgaggcagtccttcatccatcgtaatagcggtgacgttatagcgttcaggccattttccggcggtcccttcagcttgtatagacaggctcgacagaaagatgaacagagcaaatagcaaagaatgtcttttcatagtgtgtagttcattaatgacgtaagaatataccattatggaaacaaagatataccttttcgtttttccttaaaaacaaacaaatcatttttatccctctgctgtacaaatgtccaccctttaagcgatattgtccacctggcgagcttttggttgcagctatatttgcattaataataattagtcaatgtgtcaatatatcaatgtgccgattggctgcgctatatgccacatggccattgacaaattagtacattagcaaatggtcatataataaacaaaatactatgaaacagcaattttttcctcaaagattattcatggacatgaagaggttaataataaataggttggttggtttaggcctgttggtcgtaggggcattggtatcatgcaatgcacctacggctttcgtgcctgttccttcaccgaatccttgggtggatgattataccgccctttcgtctatggaaaattacaagcagtggggaacgtataatgtacacgatccggcctgtaaaaaaataggggatacctattatatgtattccactgatgctatctttgccgagaaccggaaagaggcggaagagaagaatgtaccgttaggttttattcaggtacgcaaatcaaaagatctggtacattgggattttgtgggatgggcctttcccgaaatacctgctccggctatagaatgggtccatagtcaggcggagggaaaaggggcgactaacatttgggctcccttcctgatgccttatcagggtatttatcgtttgtattattgtgtatcggcattcggcaggaatacatcctatatcggtatggctgagtcggattctcccgaaggtccctggatacagaaagggtgtgtggtcaagacaggggaaggggatgcgatgaatgccatagacccttctgttattgaggacccggaaaccggaaagtggtggatgcattatggctcttatttcggcggtctgtactgtgtggaactgagtcccgaaacaggaatgactatgcagccggaggatcatgggcacttgatagcacgccgggccaattaccggaaagacaatctggaagcgccggaaatcatgtatcagccggaacttggcaaatattatctgtttacatcctacgatccgctgatgactacctataatgtacgtgtcgcttattccgattttcccgaagggccttttgtggatttctatggagaggatataaaagatacaacgaataatgttcccattttgacagctccttaccgcttcgaaaatcatccgggatgggcgggaacggctcattgcggtcttattgatgccggtgacggccgttattttatggctcatcagggacggctctctcctcagaaccagttgatggatctgcatgtacgtgaagtgttctttactgtaaacggatggcctgtggtttctcccgaacgctatgcaggtactgctccgcgctctttcactaaagaagatttggcaggtgagtgggaaattatccgtcttcaggagccgcctctggaacgtagcttggaggccggtcagataatgtggggcgagggagacttgcgaaatggggagcaggcattgtctgcccgtgtcgttttggaagcagatggcagtgttggagatgcaacttgggattttaatgttaaaaaacaacttcttactataaaaacagccacagaagatattaacaatttgattatctttgccggacacgattgggaaaatgaaacagaaaccattctctttaccggcctggatgctcaagggcattcggtatggggaaagagaattaactaataaaaattaataatattactatcatgaaattacaccgaactctattcacagcatgggtatttgctgccggagtagcgctacatgcacagaatgcgcacaacatggtcgtgcagaccaataaacttggtgcggaaatacaaccaaccatgtatggtttgttttttgaggacattaattatggagccgacggaggattgtatgccgaactggtaaagaaccgttcattcgaattcccgcaacgttttatggggtggaatgttttcggtaacgtgaccttgatggatgacgggccgtttgaacgaaatccgcattatgtccgtctgggtaattccgggcacagggaaaaacatacagggattgaaaacgaaggtttcttcggtataggtgtcaaggaaggagccgagtaccgtttttccgtatgggcacgtggtgagaaccagaaacttcgcattgaattgatcaagaatgatacgatggaggaacgtcaggcttttgagtcaaaagaactgacagtgaactcgaaggattggaaacaatatgaggtgatattgaaatcgccgagaacggaacccaaggctcatctccgtattttccttgaaagtgcgggaacggtggatctggaacatgtttctcttttccctgtggatacttggaaagaacgtaagaacgggcttcgcaaggacttggtgcaggctttatatgatatcaaacccggtgttttccgttttcccggcggctgtattgtggaaggtacggatgaggctacccgttacgaatggaaaaaaacagtaggtgcggtagagaatcgtccgttgaatgaaaaccgctggcattatacgttcaagcatcgtttcttccccgattatttccagacttacggactgggcttctttgagtatttccagttgtcggaggatataggcgccgaaccgttgcctattctgaactgcggactggtatgccagtatcagaatgaccccgaccagcaggtcagcttgtccaaacttgattcgtatatacaggatgcattggatctgattgaatttgccaatggtgatgttacgactacttggggaaaagttcgtgcggatatgggacatcctgctcccttcaacttgaagttcttgggtattggtaacgaacaatggggaccggaatatccggaacgtctgaaacagtttgtcgaggtgcttcgtaaggcgcatcccgaaatcaagattgtcggcagttcgggacctcagtctgaaggtaaagactttgattacttatggccggaaatgaaaaatctgaaagtggatttggtggatgagcatttctatcgtcccgaaagctggttcctggcacaaggtaaccgttatgacaattacgaccgcaaaggtccgaaggtctttgccggagaatatgcttgtcatggaaaaggcaagaaatggaaccattttaatgctgctttaatggaagctgcgttcatgaccggactggaacgcaatgccgatgtggtacacatggctacttatgcgcctttgtttgctcatgtggaagggtggcagtggcgtccggatttgatttggtttgataatctgaattccgtccgtacttgcagttactatgtacaacagttgtacagtcataataaaggcacgcatgtattgccgttgacaatggataaaaaagctgtgagcggtcaggaaggacaggatggtctgtttgccagtgccgtatgggataaggatgaaaaggcttgtatcgtgaaaattgccaatacttcggataaggcacaaccggtatcagtgactttcaacggattgaagaagagtgataaacttgtggaaggtaaatgcatcacgctccagtctgccgatttggataaagataacacggtagagcatccgaatgtcatcactccgaaagaaagtgatgttacgattgagggtaatgtactgaatgtagagatggcgcccaagactttcgtgctttataagtttgttaaggcaagtaataagtaaaagatgaatcattcctttaaatgctaacacagaggatagagaaacataaagcagccgaagggctgctttataatcccaactgcatccggaacttttaaaggaaatgtatacctgtctcccttggttgtaccaagggagtttttttgattatacgtatattgtcatcttggatttttcacgttattttgctgtaaatcagtaatgtaccgtgaaaatacattctaaatccccccgaaacggtttgccattctccgctgccaaatttggtttgacggatatcggttgttctgattcctgtgtcatagctacggttgttccattgcaggggagcgtcataaggcgtatttttgttcgggtgcgttcattgcttcactaaggtgaagaggcagcttcgcttaggtgaacagccgctttcacccaagtggaataactgcttcacctgggtgaaatatcaaatggagtgaggtgaaggtatgatgagaataggttcttctgatgcctacgagctaccgggaggtaacgaggggctgattttacattctgtccgagagcatccccgaagcagatgtatttcgccaccggcataccgattgaggaggttttgaaagactgtcgcacgggaagctcttggtaatgagtgagttgttgtgatggaatgcttttatgttttatgtaaatgagtcaaaagtgatttttgttgtcgttatgttgtatgggcgggctcatgggcctgcccatacggtggaacatttgatggttatttcggatttttgaaatatcctcttattggatgagtcctgtttacatctttattctcttattgcgtacttgcctcagaatggtctgcaactcaaatactttctcaggatacttttctgctacattctcttgttcgctcaccttttccatttcatataactggggaacgttcaggtttccggtttctattttttctgctttcatgaaagtggtcgggtcatcattcggttcaatgtatttccagtctttggtacggacggacaacgtgtggttcatggattgttccacaatccaggggcggtctgtcttgtcggttcctatcagattccctaaacggtcataactgtccggagcgctgcctttaggtaatctggcgttgatcaaagctcctaaggaggctagccagtcaatctgtgacattaatacgtccgagtctcctgtcttttttatcttctgtggccagcggacaatgaccgggacggctgttccaccctcgaaagcgctgtatttgtttcctctccacggaccggaaggtgtatgtccgttcaacagctcttctgccttgtccttatatccgtcgtctacaaccggaccattgtcgctggatagaataatcagcgtgttttcagttagtccaagttggtccaatgtttccatcagctggcctaccgtccagtcgaattgggcgattgcgtctccgcgtagtcccataggattctttccacggaagcggtcatggggaaaacgaggaacgtgtacatcattggttgcaaaatacataaagaaaggctcgtctttatgctgtttgataaagtcgatggcatgaacggtgatggaatcggcaatgttctcgtctttccaaagtgcttttccgccccctttcataaatccgatgcggctgatgccattgacgatggacatgtcatgtccgttgctgggatgtaggttatacagtaattcgggattatctttgccggtcggttctcccggaaagttcttggtgtaactcacttctatgggatcggacggatcatagttggctaccttgccgttttctataaatacacaaggtacacggtcggctgtagcggccatgatatagtgatagtcaaagcctaagtcacctaaagcgggctggtaaaggagcattccaatcctgcccgcctgtcttgtctcccaggcccagatgccatttgccgatggcggctgtagcatatccggcacttttaaacatgtctgccatggtgtattgttcgggacggataatcatttttacatctcctgcggcaatatccgtgtccggtctgcgccatgcatattctcctgtcagcaaggagtagcgggatggggtgctggtagcggctacggtatgtgcattagtgaaacgaatgccttccgatgccagtttgtcaacatggggagtttctacattcttggctccgtaacattttaaatctccatatcccaggtcatctgccagaataacgataacattgggcttttggggggcctgcgtactgtttttttgaacggtttctgctgttgcagagttacaggcggctaatgaggcaagtaaggatatgcctgcataatttctacttttcatctctatttatttaaggtttgatccggatacatgtctattttcactttccggtttctcgacctgaaggtgaagaacgacggaaagttatcaagaaaatcttgaagcagcaaaaaagagggccgaaatatgatttgaaagtgtctggaattagatgataatgcccccacccagtactacatcatccctatagaaagcggctgcctgtcccggagcaatggctgtcagcggctcgtgcagttgtacatgcagggtgttatccggttgcagggttactgtgcagcggttggcttgtttccgatagcgtattttgacgatgatgtcgtccttgtttagtaataaagcgggattggtgatgcgccattctttcagtctcatttctgttttttccagtgctttcaagtcgctcagtatgactttgttttctgccggaatgatttctttgacaaagacagcccggttaagatctatgcccaatcctctccgctggccgatggtatagaaaggataacctttgtgccgtgcgataaaattccccatttcatcgaagaatttacccggtaggatacttccttcaggtaattccttatgtaggaatgtgcggtagtccatggggcagaagcagactcccagactgtcccgtttatgggcggctttcagaaaaccacgctctgccgcgatttcacggacacgggctttagtcaggttgcccatagggagaagcatacgttgcaggatttcttgtggcagcccccataggaaaaaggattggtctttatccgggtcggcaccggtagtgatgtgatagcatccattgatgaagcgccggcgtacataatgtcctgtagcgaagtgataaattcccatttcatcggatattttcttcaaaagaggccatttcaggtagttgttgcacaaggtacagggaaccggggtatgacctgccatatattcgttgatgaaatagtcaatgatggttttccggaaggtgtcacgaacatcgtatgtgagatgggggatgttcagacgttcacataaagcgcgggcgtcctccagatactctgtatcattttctttttcataaaagcggaaggtgatgccggttacttcgtatcctgcatcctgcaatagaagggcggctacggaactgtctgttcctccgctcatgcctagtaggactttattattggactctgtttctctcatctttatagcagttttgtgaggatggatgccggaatatccattttggagaaggcaaacagtttctttcccaaatctttcaaagaggctccgatgtgatatatgtcggattggtctataataagaaaacggtcatgtgcctggctattagcccattggcggaattggattcctcgtttcgtatttacacggtatcctactgatataatcacatctaaattataatattctaagttacgggtaatctgtctgttgccttcttggcgaactgttcggaaattccgaacggttgaactttggattagttcttctgatttataaatgttctttagatgctcgcttatattggctttgctggattggaatagttctactatttgtgcctgggtcagccacactgtttcatcttcaatgcgcacttccatcctcactgattcatccggctggtagagtatgatttctccttgttgttccatgtgttcgattttttgagtacaaagctagcaaatataaatcagactgatcttgttttcaggttataattgaaatgtaggatgggaaatgaaactccgatgacaatctatatgatagtgccatcggagttctgacatactcttcttattaaggaaggaatgcttgctatgtttttattttaccggcatcaatgtgaatccccaatgatattccttattggcgggtagggtatgttccggcagagggcggtctccccagctgtcataaccggctacaccttgttgcttcatatcaatacatacttccacaaaattacgtggggtgatatcattgacatgtgtcatgcggcgtattacatttttagctttttcctcattatggttagcaacttcttcgggagtgaagttagtccactgacggggacggctgatagcttcttccgagtcaaagtcctctacggagttgcgcagggcattgaatccgatagtgctgtcggcacgtattaacaatccttttccgcctttgcgggtcagttctacccaacgggtgtcggtgcggtgtccgttttcttgcggacggacatagttgttggtgtacatctggtcggctgtagtgcggtagagatcaacgaagctgcttgcattacggtcgatgtagttttcacccggtccgcgtccgaagtattctacctggttcatatcggatggcaaatggaaacgtacaccgatacgtggtacgttcagtttggaagaggcaaggcgttgagcatcctgtcccggtgtgaaagtggccattaaggtagcttctgatacttccgtgtcggcagccttcatatcggtagaagtaaaggtgatgcctgcatgaaccacaccgtcgggatagatggtatatttcatgatgtacagattgcctgccgccagtaggtaattgactgttaatacggtcttgttgccgtctgttgttgtggtaacatctgctacattgaaattcttgctggactgtttccatatttgctcgcgcttaggcccaccgttaccataatcattgtccgtcggtgcgcgccagaagttaggctgaataccaaaaccttcagcgaaatattctgtaccgtttactttgtatgaagtcacgagtccgcttctcttgttgaaaacgaactgcatacgtggtgataatacggtgatgatgtcaccatccgtgctgacggtagtcttgccgcttgctttatgtccggtcatagccaatggttctatgggcaggcggaattgttcggaagcaatatcgtgtcctgcaggaatcaagggctccggttctgtggtggtaactacaaaatctacaaaatattctgtgccggccttgggtttcaatccgttgaggttgatgttcagttctttggaaccttgcggttcgatatctaatgatacttttccgcctttgattgtttttccgtttgcctttacggtataactgatcatatactttttcaagttggtgaagtagaaacggttttttaccaggaatttgccggcagccgggtcgatggcttcgaaacctacattctgatgtgcatatttcacttctgtcatggccggatgcggagtgcggtccggagctacgattccattgcataggaagtttccgtcgctgggtgcattggttccgtaatcacctccgtaggcccagtaggtacgtccattttcgtctgtttccagaataccttggtctacccagtcccaaatgtaaccgccttgcaggttcgggtacttgtagattgctctccattgtgctgccagattaccattggaattgcccatagcgtgtgaatattcggatggtgcgatgggacggtcgctgcctttcttgcctatttcttccagccaggcggcactggggtattggggtacatacatatctgtgttccattcccaaagggcgcgttcataatttacaggacggttcatcccttttacttcgcgttctttcagccataaataggtctgatagaaattataaccgtttccggcttcgtttcctaatgaccagatggctacagagggatggtttttgttacgctcgtacatattaatggtacggtccatgtgcggcttcagccattcgggatggttgcccaatgttccgccccggcttaagttataatacataccgtggctttctatgttggcttcatcatatacatagatgccatattcatcacacaattcatagaacttgcggtcttgcggatagtggcagaggcgcacgctgttgatgttgttctgtttcatcagggtgaagtccttgcgcatcagctcttcgggaacataatgtcctgtttcgggattatgttcgtgtatgtttacacctttcagcttgatgggttggccgttgacgaacaagcaaacgtatggtttgccgttttcggctatctgatcggttggtttgatctcgaaacggcggaaacctaccgtataaggaatgatttcgcttgttttttctccgtctttcagagatatcagtaaccgatacaggttagggtgttctgatgtccaggtcttgacgttgctgagggcggcttcaaaagagatgctcttctgcccgtctgctgtaacaggacagggggtgttaccttctgcaaccactttctttgcggcatccagcaattcgtatgctacggttacctctttgttggctgctgtatggttggttacgtccacattcagtttgaagataccattcttataagtgtcgtccagtgtagacaccacattgaaatctttgatgtgggttttgggctgtgagaacaggaatacatcacgttcaataccgctcatgcgccagaagtcctggcattccagataagaaccggtactccagcggaatattttgatgaccagcgagtttttgccgggtttcaggtagttgttgattaagaattctgccggattcttggagtcttcgctgtatcccacttcctgtccgttgacatacacgtatacaccggattttgctccttccaaacggaggaatatgtcgcgtccatcccaatcggcgggaatttcgatatcacgctgatacacaccgaccggattggtttcgggtaactgcggcggttgtggatttctgggtttgaattcgtatccatgattggtgtagatggccactccgtagccctgtacttcccagttgccgggtactttaatctccttccaggctatgttggcatccggttgctcaatgttggcaggcagatctttgtatgcatctgcataataaaagttccatgtaccgtttagtagtttgtaataagggctgttctcatactcgccggtcagtgcctggttccggttgtcgtaagtcatgaaagctgtgcgtggatattccttgttgacggctacggtctgaatatctttccaataaggtagttttgtatcttccgcatgaagaacttgtgttgaatatgcgcatacagcagcgctgatcaggaatttaaataaggttgtcattttaggtttcataggttcaaatagaaaaatgaagaagaaagggcgctagtaccggcgcccctttccttaagtccttttatgtaaaatagcaattatttaattgcgtctgccagttcagcacctggtttgaacttggttacttttttagcaggaatagtaatcgttgcttttgtggatgggttgatacctgttcttgcacttctttcagcaacagagaatgttccgaatccgattaatgatactttgtccccttcttggagggcctttgttacagttgaaacgaaagcttcaactgctttttttgcgtcgactttgctcaagccggcttcagcggcgactgcgctgataagatctgccttattcataacgaaaatgattaattattaaatgtaacacaaaagttttaccaaaatcagtgacaaatatatgctttcaaaattagaaatcaaacagatagcctaaaaaagatgctccaaaaatcaaaaaaacgtaagagaactcttgttttctgttatataacagaataaaattgtaaatttgcgcgcaatcaatgttttattagacgaagaatatttatgaacagtatacctacagtaaccaagaatttattgataataaatgtgttgtgtttctttggaggcgtggtagccatgaagtatggaattaacctaaacgacctgctgggactacacttttttatggcgtctgattttaatcctgcccagttgattacttatatgtttatgcatggcggtttccagcatatcttttttaacatgtttgctttgtggatgtttggccgtacgcttgaacaggtctggggaccgaaacgtttcttatcctattatatggtatgtggtataggtgcgggactggtgcaggagctggtgcaatatatacaatatgtgactgaattatcgcagtatgacagtgtgaatacggggattgccgtgatcccgatggcggagtacttgaatctgatgactacagttggcgcttcgggagcgatatatggtattttgttggcattcggtatgctgttccccaatagtcagatgtttgtattccctatcccatttcctgtcaaggctaaatattttgtgatgggatatgctgctttggagatatttttgggcttgggtgcttcgaccgatggcgttgcccactttgcacacttgggaggtatgatttttggctttatattgataatgtattggagaaaaaagaataacaatgggcagttttattactgatttgaaaaatagtttcaacaaagggaacatatatatccagtttatatatattaatgtaggggtattcattgtaacttccttattgggaattttatggatgctgttcaaccggaatggagcatttgtgcttcaatatttggaactgccggcctggacgttgcagtttgtcaagcagccttggtctttgctgacttatatgttcatgcacgcaggtattttgcatttgctgtttaatatgctgtggctttattggttcgggcagatgtttctgtctcttttctcggcaaagcatttccgcgggctctatctgttgggaggtatttgtggcggtttgttgtatatgatcgcttacaatgttttcccttatttcagtgattctttgtattattcttatttgttgggagcatcagcttccgtacttgctattgttgtggccactgcggtacgtgcaccggaatatagagtaaactttatgtttattgggactgttaggttgaagtatgtggctctgtttatggttgtgaccgatttgctgtttatgacatcgggcaatgccggtggccatatcgctcatttaggaggtgctttggccggatggtggtttgcttccggattgtcccgcggacatgatgctacgtcatggataaaccgatgcttggattgcttctcggaaggtctttcgtttcgtcgtcaatcgaaaaaaccgaagatgaaagttcattatggtgataaggcaaaagattacgattataatgcccgtaaaaaacagcaaagcgaggagatagaccgtatattggataaattaaagaaatccggttataacagtctgactaccgaagagaagaaaagcttgtttgatgcgagcaagaagtgatatatgaaatatattggtcgttttttgggatggatactactgggcataaacttgtgtatggtggtattgttactggtatgtgcttacagcccttatattgatcctgtggctcatccggtatggtcatgtgccggtttggcttttcccgcttttttgattgttaatcttttgtttctggtcttctggttggtgatttatcgtaaatatgcgttgctttcatttttaggcctggtatgttccattggtgctatccgtacttatttcccagtcaatgtatttgtatctgatgtaccggaaggggcaatcaaattcttatcctacaatacgatggcctttgaaaagaaccgtgcgaacaccaaggataatccgaaccctgtgctggaatatttaagaaacagcaatgcggatataatctgcctgcaggaatatattgtaggcggacgcttaaccaagaaagaggtggattatgctttaagagattatccttataaaaattatcataagatatcgggggccaacggtttgggttgttattcccgttttcctattttgtcggcacatccggtgaaatatgccagccttaacaatggttccattgcttataaaatcaaagtgaatggtgataccttgctggttgttaataatcatctggaatccaataagctgactgagaaggataaagaagtctatcgcgaaatgatgaaggaccctgataagcaaaaggtatcgcaagggtctcgtttgctgatcagaaaactggcggaagcatcggctatacgtgccgttcaggctgattccatagctcgtttggtggccggttacaaagggggaggcataattgtatgcggtgacttcaatgattctcctatatcatacactcacagggtggtaggagaagggctgaatgatgcttttgtggagtcgggaaacggctttggcatatcttataatcaaaatcatttttatttcagaatagacaatattttattgagcaagaatttaaaatcttaccgttgtacggtggataatacgataaagagttcggatcattaccccatttggtgttatgtggcggagaagtgattttacatacctttaattgacagattatgaaaagactattatttacgttagcgacgtgttgcgtaatgtgtgcatgtgaacagaaaacagaaatgaatccgttctttacggaattccagaccgagtacggtgctcccgattttactaagatcagactggagcattatgaacctgctttcttgaaaggaatagaggagcagaatgcggaaattaaggcaatagttgataatcccgaggaacctacttttgaaaataccattgtggcgctggataaaagtggcgggattctggcgagagtaagtggggtgttttttgcattgaccgaagcggatacaaatgattcgttgacggccttgaatgaaaagatggctcctgtactttcagaacatagtgataatatttatttgaatcaggatttgtataaacgggtggctgatgtgcatcaacaggaacaggaaggtaagataactcttacgactgagcaacaccggctgttggacaagtattataaagcttttgtccgttcgggtgccggactggatgccggaaaacaatcccgtttgagggagatcaataaagaattgtcgactttggggattgctttcgacaatcatatcttaaatgagaataacgcttatcagttggttatcgagaatgaggctgatttggccgggttacccgaatgggtgaaagcgggggccgcagaggaagcgaaagctgctggaaaagaagggaaatggctattcactttgcaaaactccagtcgcttgccttttttgcaatatgctgaaaaccgtgagctaagaaaaaatatttatgaagcttatatcaaccgggggaatcatgatgatgcgaatgacaataaagagatattgggaaagatcatggcattgcgtttggaacaggcaaaattattaggattcgattgttattccaattttgtactggatgagaacatggctaagaattcgcagacagtcatggatttcttgaacaacctgtggggatactcactggaaaatgcaaagaaagaggccgccgagttgcagaaaataatggataaggaaggtaagggagagaagctggctgcatgggactggtggtattatgccgaaaaattgcgtcaggaaaagtatgatttgaatgaagatgaaatcaagccctatttcagtttggaagatgtgcgtagcggattgtataccgtggccaacaagctgtatggcattacattgaccgaactgaatgatgtgcccgtatatgagccggatgtgaaagtgtatgaagtaaaggatgccgatggctcatttttgggattgttctatgcggattactttccacgcgcaggtaagcgtggtggcgcatggatgagtaattttcgtgaacaggccggtgaagtacgtcctttaatttataatgtggcaagttttactaaacctgcaggaaatatgccttctttactgactttggatgaggtggaaaccatgtttcatgagtttggacatgcattgcacggtatgctgaccaagtgtaactacaaaggagtgtccggtaccagtgtggcgcaggattttgtagaacttccttcacagattatggaacactgggctgtagaacctgaagtgctgaaactctatgccaagcattatgaaacaagagaagtgattccggatgagctgattacgaaaatccaaaatcagggtacttttaatcaaggttttatgactacggaattattggcagccgctttgcttgatatggaactgcataacctgactgatacagacaacctgaatgtcgttgcttttgaaaaagaaacgatggacaagctggggctgattcctgaaatagctcctcggtatcgcgccacttattttagtcatattataggtggatatgctgctgggtattacagctatctatgggcagaagttcttgacacggatgcttttgaagcgtttaaagaacatggagtgttcgataaaaataccgcagactctttccgtaaaaatattctagagaaaggtggaacggaagatcctatgaccctttacagaggttttcgtggggctgatcccagcttggaacccttgcttaaaaacaggggtttgaaataaaatagactgtgagatagaataatttaggctgcaaaaaatgcttttgcagccttttttctcttttggaatctaaatatttgtgtttgataccgtgggaatgtgaaaaaaaaactatatttgcaaccttgtataaactaagaattaatcaaaaagtaaaaataataaatttcaaagtaacatgcaaaacaaaggatttgtaaaggtttttgcggtattactcacccttgtatgtgtgttttatctttctttctcttttgtgacccgctatcacatggacaaagcggcacaagacccgaaaggtgaagcacattaccttgattctatgcagaatgaaaaagtttatttgggtagttatacgctgaaacagtgtcgcgagatggagattggtctgggtctggacctgaaaggtggtatgaacgttatccttgaagtttctgtaccggatgtagtgaaggctttggctgacaacaagactgatgaagcttttaacaaagcggttgcagaagcatcaaaacaatctatcactagtcaggatgactttatcactctttttgtaaaagagtataagaaacaagctcccaatggcaaattggctgaattatttgctactcagcagttgaaagacaaagtaaccacccgcagttccgacagtgaagttgaaaaagtattgcgcgaagaggtaaaggctgctatcgacaactcttataatgtattacgtacacgtattgaccgttttggtgtggcacagcctaacattcaggcattggaaggaaagatgggccgtatcatggtggaactgccgggtatcaaagaaccggaacgtgtcagaaaactgttgcagggatctgctaacttggaattctgggaaactttcgacgcaaaagaaatagttccttatctttcttctgtagataacagactgcgtgatattcttgccgttgaaagtggtgctgcttctgctgattctgtagctactgatactgttgctgttgcacaggcttctgcaatttctgctgccgacagtcttgcagccgcattgaaaggcgaaacggcaagtaactctgccgcaatggagcagatgaagaaagaacatccgttggcttctgttcttcaattaaatccgaatggttacgggtcggtggtaggttatgccgattataaagatactgctcaggtaaaccagtaccttgctatgaaagaagtgaaagaaatgttgccgaaagatcttcgtttgaaatggggtgtaaaggctgctgactttgacaagcagggacgtatttttgaattgtatgctatcaagtctactgaacgtaacggacgtgctccgttggaaggtgatgtgatcactgatgctaaagatgaatatgaccagttcaacaagccttgtgtcagtatgtctatgaacactgacggcgcacgccgctgggctgttctgacaaagaacaatgtaggcaaggctatcgctattgtactggatggttacgtatacagcgctccgaatgtaaacggtgaaattacggggggacactctcagattaccggtaactttaccccggaggtgacaaaagacttggctaacgtattgaagtctggtaagatgcctgctcctgcacgtatcgttcaggaggatattgttggtccgtcattgggtcaggaatctatcaatcaaggtattatttcatttgttgttgcgttgattctgttgatgatctatatgtgcgctatgtacggattgattccgggtatggttgccaactgcgcattggttgttaacttcttcttcacattaggaatccttacctcgttccaagctgcactgaccatgtctggtattgccggtatggtgttgtcattgggtatggctgtagatgctaacgtgttgatttatgaacgtacaaaagaagaattgagagccggtaaaactgttaaggctgctttagcagacggttattctaacgcattctctgctatttttgactcaaacttgacatcaattatcactggtatcattctgttctatttcggtacgggtccgattcgtggttttgccactacgttgattatcggtatcctctgctcattctttacagcagtattcttgacccgtattgtttatgagcacttcatgaataaagacaagtggttgaacttgacattcactacagggatctccaagaatctgatgcagaacgtgaattacaactttatgggaatgatgaaacgttcattcacggtattcggagcgattatcgttatctgtatcatttcattctttatccgtggtttggcgcagagtattgactttaccggtggacgtaacttcgtagttcagtttgaacagcaggttgaacctgaaacagtgcgtgacctgttgaagaagaaaatcacagaagataatgtacaggctattgctttgggtacagacaagaagacaatccgtattacaaccaattaccgtattaatgaagattctcctactatcgactctgaaattgaagagttcttgtatcagtctttgaaagatggtaacttgctgggcgaaggtactacattggaaatctttattgaccgtgataatcgtgtcggtggttctatcatcagttctcagaaagtaggtcctagtatcgctgatgatatcaagacttcggctgtctggtctgtattgtttgcattggtggctatcggtttgtatatcttgctgcgtttccgcaatgtagcttatagtgtgggtgcgactgttgcattggctgtcgatactattttgatcatcggtgcatactcgttatgttatggatgggttccgttctcattggaaattgaccagacttttattggcgctattttgaccgctatcggttattctatcaatgacaaggtggttatctttgaccgtatccgtgagttcttcggtctgtatccgaaacgtaaccgtatgcagttgtttaatgattcattgaatactactttggctcgtaccatcaatacttcattaagtacattgatcgtattgttgtgtatcttcgtgctgggtggtgacagtatccgcagcttcgcctttgcaatgattttgggcgttgtgatcggtacattgtcttctatcttcattgctgctcctatcgcttacctgactatgggtaacaagatgccggaagaaacaaaggcataagaaggtttcttttaagaaataaataaaaagaggaggatgctcatatcatgagcatcctcctctttttataaggtcgattggaattggtttgtggaaaaagggtagatgaatcttctgtggcttcaaaaattaacttaagtacattgggtaagtaacttagcttgcttggtatttcaacttaacttgcttgtcccatgaagttaacttgcttttttacgcagtatcttgcagatcaattctgtttggctataatcgtgaaaatagttatctgactactcttcctgaagtgtttccttgcattaactcttccacttcttctactgttacttgattgaaatctccatatatggtatttttcaatgcagatgcggcaagggcgaattccaatgttttttggtcattgtcggggtaggtcagcaaaccataaatcataccgcctacaaatgcatctcctgcacccacacggtctacttcatggacaatatcgtaaatgccggtatgctttaatgttcctttagaataaagtatggctgccagcagattgtgattggaagtgatggtattacgcaactccagaaacattttctggcatcggggagcttgttctgatactttttgaccgaatactttgaaaccggacaaatctaatggatatgaggtgtctacagctttaaaacctaccgggggaatgccgaaaatttctttgtattcgggttctgcaccaaaaatgacatcactatattgaacaagggggagcattacctctgatgcggatttaccgtaattccataattttttgcggaaatttaagtcgcatgagattgttaatcccaggcggtctgctgtttgcagtgcttccaggcaggcatctgctccttcctgtgacagggacgctgctatacccgaccagtggaaccagcctgcatcggaaagaatcttttcccagtctatcatgccgggacgtaaagtggcaaaggaagagccttcacggtcatatactacattggagttacgaaatgctgcaccgctttccagaaagtataatcccatgcgtttcccaccataaataatgccgtctgtacctaatccgtaagcttggagtgagtttacgcaggcttgtgccattgcattctcgggaagtctggtaacgaattctgtggggatgccgaagttgaccagtgatatggctacattcgcttcacttcctccataagtagcaataaactcgtttgtttgggaaaagcgctggaaattggggacggtcagccttagcattacttctccgaatgtaacgactttcttgttctgggtaatagctcttgtattcatagtatgtttttaatcagtatgttaatttgcacgaagatacgatcaaaattttatataagtgcaagaaatgtataaaaatagccttctctatcttttccatatagaatagagaaggctattttatttattcaatattagtggtttatttattgaatcgtatttttagtttggcaagcatatcctgtgtcatgctgtctagatcatattccggtttccatccccattcctcacgggcacaagtgtcgtccagtgagttcggccatgattcggcgatagcttgacgtagtggatctactttgtactccatatggaagtcgggcatatacttctttatattgttataaataatttccggatcaaaactcattgaagcaatgttgaacgaattgcgatgaattagtttgtcgggattcgcttccatgatttcaatggctgcacgtaaaccgtcaggcatatacatcatatccatgaatgtaccggctgcaataggacattcaaatttttcaccttttacagccgaataatagatgtctacagcataatcggtagtcccgccacccggaggtgtgacatacgaaattaatccggggaaacgaacggagcgggtatctacgccaaaacggatatggtaataatcgctcagtaattctcctgatacttttgtaacgccatacatggtacgcggattacggatagtgtcttgcggggtcttgtctttaggggtgttgttgccgaagacaccgatagaacttggggtaaatacggcgcaacccatttcgcgtgctacttccaatacgttgaacaggcctcccatgcctattttccatgctagttgaggtttggcttctgctacagccgatagtaaggctgccaggttgtaaatggtgtcgatgttgtactttgatacagtttcggcaatttgttgttcgttggtgatatctacgatggcagaagggcctgattcttttaattcccctttaggctcagcaccgggaatatatccggctacgatattaccattgtaaatacttctcaatttcatggttagttccgaaccgatctgaccggtggagccgataattaatacatttttcatagttcgctatttgctttaagttttcttttgaaagcaaagatagatagaaaactgcatattttatcaaaattttctctataatttaatcggatatcaaaaaaaaataagaactttgtcaagccagactgatttttaaacttaaactatatacttaataaaaaaacaaagctatgtatggtaaaatgaaggagttccttgcgaaggaactggctgatattaaggcagccggattgtataaaaatgaacgtataattaccacacctcagcgtgcggacatcaaggtgaatgacggagaagatgtgttgaacttttgtgccaacaattatttaggtttgtcagataatcaacgcttgatcaatgctgccaaagaggcgatggacacacatggcttcggtatgtcttccgtacgctttatctgtggaactcaggatttgcacaaacagctggaagctgccatttctgattattttaaaacagaagatactatactttatgcagcttgttttgatgctaacggtggtttgttcgaaccgctgtttacagaagaagatgctattatttcagatgcgttgaatcatgcatctattatagatggtgtacgcttgtgtaaggcaaaacgctatcgttatgccaatgctgatatggctgacttggaacgttgtttgcaggaagcgcaggcacagcgtcatcgtattattgctacagatggtgtattctcgatggatggtaatgtggctccattggataagatttgtgaactggcggaaaaatatgacgcgttggtaatggtggatgaatctcattcggccggtgtggtaggtcctacagggcatggcgtggccgaacagtttaatgcatacgggcgtgtggatatctttactggtacattaggtaaagcatttggtggggcaatgggaggatttaccaccggtaagaaagaaattattgatatgttgcgccagcgttcccgtccttatttattctctaattctgtagctcctgccattatcggtgctagtctggaaatgtttaagatattgaaagaaagtgatgctttgcatactaagctgatggataatgtgaattatttccgtgacaggatgctggctgccggttttgacatcaaaccaactcagagcgcgatttgtgctgtgatgctttatgatgcgaaactgtctcaggattttgccgccaagatgcagaaagagggcatatatgtaaccggtttctattatccggttgttccgaaaggacaggcacgtatccgtgtccagttgtctgccgggcatgaaaaggcacatttggataaggcaattgctgcatttattaaagtgggcaaagaacttggggtgattaaataagcagatttgaaaactatctagtaaaataagagcagtaaacggttgtataacaattgtttactgctctttgtagccccgaggggaatcgaacccctatctaaagtttaggaaacttctattctatccgttgaactacaaggcccctttatgggtacaaaggtacttctttttgttaaaatggcaatatgaaagattgaaaaatgtcttaagtgggaagaaaataatcctttctttgttgttttgttgttttttgtctgttttttataatctaataatgttgttattctgctataaactttcatgttgttcataaaacatggataaaaataataaattgtaaaaatgaatcgtttttgatgctgtcataatgataggaatttatgcttttaaacaggtaattatctctgctttttcttagcttggaaacaaataaacctttaattttgtacattttgatattcaaacgtagtttgatagcggaatattttgtcctttgacagaactttccgaactttgcaaacagtgaaattttgtaaccctaaataataagttatggcagatgaaatgatagtcaaggagttggaccaagtggtggtccgtttctcaggcgactcaggcgatggtatgcagctggccggaaatatcttttctaatatttcggctacagtgggaaatgatatcagtacattccccgattacccggcggatatacgtgccccgcaaggttcgttgaccggtgtgtcaggtttccaggtgcatatcggtgcgggtaaagtttttacccctggtgacaaatgcgacgtgctggtcgcaatgaatgccgctgcattgaaaacacaatacaaatttgcgaagtccacagcttgtatcattattgatacagattgttttcagaaatcagacctggacaaggcggctttcaaaacagacaatccgattgaagaaatgggtattaagcaggatgtaattgctgctcctatttcgcagatggtgaaagattgtctggcagatacaggcatggacaacaagtcaatgttgaaatgtcgtaatatgtttgctttgggattggtctgctggttgtttaatcgtgacctggcggttgctgaaaatttcttgcgcaagaaatttgcaaagaagccgcaaatagctgaagcgaatattaaagtgatacacgccggatatgattatgggcacaatacgcatgcgtctgtggatcatacttataaggtggaaactaagtctaaagtacctggaaagtacatggatatcagcggaaacaaggctacggcttatggcttaattgctgctgccgagaaagcaggtctgcgtttgttcctgggatcttatcccattactccggcaacagatatcttgcatgaactttctaaacataaatcattgggagtgactacggttcaatgtgaagatgaaatttcaggttgcgctacggctatcggtgcctcgtttgcaggtgcgttggcagctacttctacttcgggaccgggtgtttgtctgaaatcagaggctatgaatctggctgttattacagaattaccattggtggttattaatgtacagcgcggcggtccttctactggtttgcctactaagtctgagcaaacagatttattgcaggctttgtttggccgtaacggtgaatctcctatgccggtcattgccgcagcttctccaactcattgttttgatgctgcttatgatgcttgtaagattgccttggaacacatgaccccggtggtgttgctgactgatggttttgtagcaaatggttccggtgcatggaagttgcctgatctggcgaactatccggctattaacccaccctatgttactccggaaatgaaggataattatactccttacaagcgtaacgccgaaacaggtgtccgttattgggcattgccgggacaggaaggttatatgcatattttgggaggcttggaaaaagacagtgatacaggtgctatttctaccgagcctgaaaaccataatttgatgtgccgtttgcgtgccgagaaggttgctaaaattccagtgcctgatgttaaggtgcaaggctgcgtagaggatgcagatttgctgatagtaggtttcggtggaacttacggtcatttatattcagcaatggaggaaatgaaccatgcgggcaagaaggttgctttggcacattttgttcatttgaacccgctgcctcacaatacggcagaagtgctgaagaaatataagaaggtagtcgtggctgagcagaatcttggtcagtttgccggatatctccgtatgaaagtggacggatttgttccttatcagtttaatgaggtaaaaggccagccgttcgtagtcagcgagttagttgatgctttcactgagattttaaataaataataaccgtaaagaaagtaaagactatgaacgaatatacagcaaaagatttcaaaaagggacaacctcgctggtgtccgggttgcggtgaccattttttcttggcttcgctgcacaaagcgatggctgaattgggagtggctcctcatgatactgccgttatttcgggtatcggatgttccagccgtctgccttattacatgaatacatatgccatgcagactgtgcacggtcgtgcggctgctatttctacaggctgcaaggtggctaatccgaagattactgtctggcagatttcaggggatggtgatgggctggctattggtggaaatcattttatacacgccgttcgtcgtaatatcgacttgaatatgattttgttgaacaaccgtatatatggtttgaccaaaggacagtattctccgacctctccccgtggatttgttagcaaatcatctccttacggcactgtggaagatccgtttcatccggctgaattatgttttggtgcgcgtgggcgtttctttgcccgtgcggtagctacggatggtcctggtacagtggagattctgaaagctgctgccaatcataaaggtgcggctgtatgtgaaattcttcagaactgcgtcatttttaatgatggaacacacgaatcagtatatacgaaagaaggtcgttcaaagaatgccatttatttggaacacggtaaaccgatgttgtttggggtagataaagaatacgggctgatgcaggaaggtttcgggctgaaagtggtaaagattggcgagaatggtgtgacggaaaaagacattttagtgcacgatgctcattgtatggataatactttgcagttgaaactggcattgatggaaggaccggattttccggttgcattaggtgtgatccgtgatgtggaagcgcctacttatgatgacgccgttaatgcacagattgaagaagtggccgcaaagaaaaaatatcataatttccaggaattactgatgacaaatgatatttgggaagtgaaataatatttttcatcttccctgtaggaaccggatctacagagttgttctaaaaattaaatggttagtaataggcagtgaataattgccggttactaaccatttaatttagaattttagtgtgtaagagaacacacctgaaactgtccttatagtttgagctttagagtttctcgccgaatgataaatcaccggcatcccctaaccccggaacaatgtatttgtgctcgtccaagacagggtctatggcggcacaccataatgtgacatcatcgccgggaaaaagttctgccatatgcgctaccccttgttggctggcaatgacacaggccatctgcaatttagctggtttgcctttggtaaggaacgctttccaggcaagttccatgctttcaccggtggcaagcatgggatcaacgagaagcaaggttctgtcattcaatgaaggagcggcgatgtattcaatgtgtacatctacaatacggtgttcatcatctttgtaaaaacggaatgcggaaacgaaagcgttgtcggcatggtcgaacatgttcagaaaaccggtgtgcagcggcagtccggcacggaataccgttgcgatcactattttgtcatcgtgtgtgctggccgtggcagttcccaagggtgtctgtacttgctttacggaataggttagtgctttactcatctcgtatgccatgatttctcctattctttcaatatttctgcggaaacgcatacgatcattttgaacatgtacatcgcgcaattccgctacatattggtttaggagagaattgccttcactgagattgatgattttcatatctatgcttttgttatattgttgactttgacctgcaaagaaacaaataatttctagatttgtaaagtacgaattgcatttttgttacacaaatataaatatttgattattacggaaatttttctctaataacttcttttttttaaaataaagcactaattttgtagcgccttagacaagggggtgttgaaaaacatcttctttcagaaaataaagagtaaaaataacattatacaataaccaaattaaatcattaaaaaatggcaaatttagatttaagcaagtacggtattaccgacgtgaaggaagttctccacaatccttcttatgatgtgcttttcgctgaagaaactaaaccgggattggaaggtttcgaaaaaggacaggttactgaactgggtgctgtaaacgtaatgactggtgtttacacaggtcgttctcctaaagataaattcttcgttaagaatgaagcttctgaaaattcagtatggtggacttctgacgaatataaaaacgataacaaaccttgtactgaagaagcttgggctgacttgaagtctaaagctgtaaaacaattgagcggcaagcgtttgttcgttgttgatacattctgcggtgctaatgctgcaactcgtatgaaagtacgtttcatcatggaagtagcttggcaggctcatttcgtaactaacatgttcatccgcccgactgctgaagaactggaagcttacggagaacctgattttgtatgtttcaatgcatctaaagcaaaagttgacaactataaagaactgggcttgaactctgaaacagctactgttttcaacttgaagactaaagaacaagttatcctgaacacttggtacggtggtgaaatgaagaaaggtatgttctctatcatgaactacatgaacccgcttcgtggtatcgcttctatgcactgctctgctaatacaaatatggaaggaactagttcggctatcttcttcggtttgtctggtacaggtaagactactttgtctactgacccgaaacgtaagttgatcggtgacgacgaacacggatgggatgacgaaggtgtattcaactacgaaggtggttgctatgctaaagttatcaacttggataaggaaagtgaacccgatatctacgctgctatcaaacgtgacgctttgctggaaaacgtaacagttgatgctgacggtaagattgatttcgctgataagagcgtaacagaaaacactcgtgtttcttatcctatctatcatatcgaaaacatcgttaaacctatctctaaaggtcctcacgctcaacaagttattttcttgtcagctgatgcattcggtgtattgcctccggtatctatcttgaaccctgaacaagctcagtattacttcttgtctggatttacagctaaattggctggtacagaacgtggtattactgaaccgactccgacattctctgcttgcttcggtgctgctttcttgtcattgcatcctactaagtatgctgaagaattggttaagaagatggaaaagactggtgctaaagcatatttggttaacactggttggaacggtactggtaaacgtatctctatccgcgatactcgtggtatcatcgatgctattttggatggctctattgataaggctcctactaaggttattccttacttcgatttcgttgttcctacagaattgccgggtgttgatccgaagatccttgatcctcgtgacacttacgctgacgctgctcagtgggatgaaaaagcaaaagacttggctggtcgtttcatcaagaacttcgctaagttcactggtaacgaagcaggtaagaaattggttgctgccggtccgaaattgtaatctgaattttacagatttaacatataaaaagtggttcctatcgggaaccacttttttttatgcttgaaaatgcctagatttgttgcaaaccaaatatgatagcaaatgaaattatttagattaatgttagttggtgcaggtatgttcgtattatgcagctgtacatcgcaaggttctcaacagaaggaagttgttacggatagtgtttccgtgagtcaggtagaccctgtaatagaaactattatgagccgccgtagtatacggaagtataagcccaaggctgtggaacgtgaaaaaatgcagactatagtggaatgtggaatcaatgcacctaatggaatgaataaacagtcatgggaggttcgtgtagtagataatccggaatttatcaatggtttgactgaaattttcaaaaaagaaaatcccaaagcggcagaacgtccgggatttcagaatatgttcaataatgctcctacagtagtgtttattgctaacgatcctgcatatgatatgtcacagatagattgtggtctgttgggtgagaatatgattttgtctgcttggtcaatgggaataggttcctgctgtttgggagggcctgtgcgtttcatgaaatcacctgcagctgccgaatatatgaaacagttgggattcagtgaagggtatgagttgctttatgcgattgctttcggttatcccgatgaaatgccggctgctaaacctagagaagttagtaaagtaaagtttgtagattaaatataaaaaatcccgaaggtaatatggtctccgggattttttatattaaaggtagattgattagcttttgttagctctcttacgttctgtttcgtcaagaatcactttacgcatacgcatactctttggagtaacttctacatattcatcttccttaatgtattccaatgcttcttccaacgaaaatactaccggaggaatgatgcgtgccttgtcatcagaacctgatgcgcgcatattggtaagcttcttcgatttagttacattgataaccaagtcgttttcatgaacatgttcacctactacttggccggcatatacttcgtcttgcggataaatgaaaaatttgccacgatcctgtaatttgtcaatagcgtatgcaaaagctgttccgctttccatagcaatcatagaaccgttgctgcgacgttctatctcgcccttgtatggttggtagcatttaaaacggtgagccatgatcgcttctccggccgatgctgtcagtacattggtacgaagaccgataataccgcgcgaaggcatatcaaactcaatgtttacacggtcaccctgtgtttccatagaaactaaatcacctttacggcgggttaccatatcgatcattttactggaatattcttcgggtacgctgatcgttaattcttcgataggttcgcattttactccgtctatttctttgaagataacctgaggctggcccacttgtaattcgtatccttcgcggcgcatggtttcaatcaggacagaaagatgaagcacaccacgtcctgaaacaatccatttaccgtcctccaattcgcttttgcgtacacgcaatgccaggttcttatccaattctttggtcaagcggtcttggatgtggcgtgaagtcacaaacttaccttctttgccgaagaaaggagaatcgttgatagtgaataacatactcatggtcggttcgtcaatggcgatggggggcaatggttccggattttcgaaatcgcagatagtatcaccaatttcgaagccttctacacctactacagcacagatgtctcccgatgaaacggcatttgtctttttacgtcctaagccttcaaaagtatgtagctctttgattttagactttatcagactaccatcacgctttgctagtgtaatattcataccttctttcagcgtaccacgatgtacacgtcctacagcaatacgacctgtatatgctgaatagtctaaagaggtgattaacatttgaggagttccctccaactgtttcggtgccggaatatgctcaataatagcgtccaacaacggaaccaggttttctgtcggggttttccaatcagtactcatccaattatttttggcagaaccatagataacggggaaatccaactgatcttctgtagcattcaggctgaacatcaagtcgaataccatttcgtatacttcttccggacggcagttgggtttatccaccttgttcactacaactacaggtttcaaaccgatctgtaatgccttttgcaatacgaagcgtgtctgcggcatcgggccttcgaatgcgtctaccaataagatacatccatcagccatattgagtacacgttctacttcgccaccgaagtcggcgtgtcccggagtatcaataatattgatttttgttcctttgtagttaattgaaacgttctttgaaaggatagttatccctctttcgcgttccaagtcattattatccaataccagttcaccatttgtctggtcgttgcggaacaaatgtcccgccagcatcatcttgtccaccaaagtcgtttttccgtggtctacgtgggcgatgatcgcaatgtttctaatgtcttgcatactatacctatatatttggctgcaaaggtacgatttttaattcaaaaaatatttggctgttaacgattattttttatcttccgtatcttctttacttttaaatgtagagggagtggtgccatagaaatcgacaaaatgctttctgaaggtggagatgtcattataaccaaccatctcatgacaggtatcatgacatccgttattacaagatccggtattaagtataaaggagaatgttatgagcagcctgttagaaatcatggataaaaaatcatgcggtaaatggtatgcctatgaacagtctgctttttatttgagccggatgatgcttgagctttctttagaccgttatgtgatggaaaatgctttgtggctggcaagggcggaaattgatgtaaaccggattccttgggataaagttatcagtcatagccaatccgaatatgtattgcactataccccttatgatgggttccatgagtggctggttgaaataaaatagcgatagtttaaaaagtgtccagtccgaaattcatgaagaaacggtttcggactgggcacttttattcatcggatgaaaagaaatcgggtttacaatttcattcaatgtcagttgggcagcctttgctatgatgttcgaagatatgctgaaagatgcgacagtaaaagagatagaagattatttttaaaataaatcgctctaattcattgtgatataaaagataatgtctatctttgcacccgctaaatgaaaattttatatatcaaaaaatctaagaattatgtatttagatgcagctaaaaaacaagaaatctttgaaaagtacggaaagtctaacactgatactggctcagctgaagcgcagatagctttgttttcataccgtatttctcacctgactgagcacctgaagctcaacagaaaagattatagcactgaaagagctttgacaactttggtaggtaaacgccgtgcgttgttgaactacctgaagaaccgtgatatcgaaagatatcgtgctattgttaaagcactaggattacgtaagtaattcaatctttattgaaaaggacttaaagaaaagccgctctctgaaaagaaagcggcttttctattttctgttattacgtttctactgttctgttgttgagaattactctttagtaggatagtacagattatcttttgtcatgtgctccaatacttcatgcagatatttggccgactcccatttggccataggcaggtcgtgaagcaagtagttaccgcaatctttaggggaggctcccggaacttcgccttcaaaatcggctacaaagcggaacgtttcctgcatcagttctacaatatcttccgattttaaatcgcctttcattaacaggtagttaccggtgaggcatcccatcggtccccagtagacaattttgtcagaccatatagggtggttacgcaggtaggtagcggctagatgctctatggtatgcaaggctccttgtcccaaagcaggttcccggttgggttctttcatgcggatgtcaaaggtggtgaccgtttcaccgcccacttcgtcttttctggatacatagataccgcgaagcaagcggatatggtcaatggtaaaactgggtattgttttcatattattcgtttttataaattagctggtaatgaggaaaggaaggtatgagtgacctcgaaggaacggtcggctatagtctcccaaaaatttgtgtattgttcccaatggttgtcggatcccggcgtatcgctgatgatacggaaactgatgaacggtaccttatatatataacagatttgggcgatggctcccgattccatatctactgccagcccttcgtggaacttttctttaatgtcgttcagttcggaacggtcggtgatgaatttgtctccgctgcatatcagacctccatgaatggcggtcggagtatccagtgacatggcgcaatcaaacaatgtggcattaccttcgaatcgggcgggaagtccttgtatctgtccgtacatattgccttctccacaccatacatcatgatatacaacttgtcggctcaccacaacatccattattttcaggcagctgtctatgcctcctgctacaccggtgctgatgacacagtcgggttggaaggtacggatcagttctacagtaccggcagcagcgttcactttacctattccgcatttcatcaggataatggtattatttctaatgctgccttcagtatattggaaaggaccttcggtgtattctttcttgttttcgagcagttgcgctacttgtttctgctcggaactcatggctgttataattcctattttcataattcaactttatttatggctgcaaatgtacgcattttatcagagtatatcgtatctttgcaacgttaataaacagatatacttatgaacttatttaaaagaatactacctgatatagtagtgattatcctttttgctgtcatctcattcgtctattttttcccggcagtgacagaagggcgtatcctttcacaacatgactctgtggcgggcattggtgccggtgaagaagcgaaagaatatctggaacgtacgggagagcgtacgcgctggactaattcgatttttggtggtatgcctacttatcagatggcacccagttatgattctacggataccctgaagggagtggagaagttatatcatttgtatctcccgaattatgtgtggtatgtatttgtcatgctgttgggcttttatatattattgcgtgcattcgatttctcggtctggctggcttcattgggggctgtgttgtgggcgttttcttcttattttttcatcattatagctgccggacacatctggaaatttgtaaccttggcttatattccacccactatagccggtatggtattggcttatagagggaaatacttgtcaggtggtttgctgacagcggtttttgttgctttgcaaatagtgtcgaaccatgtgcagatgagttattattttctttttgtcatgctctttatggcggttgcgttcggagtggatgcttggcagaagaaggaaatgccgcaatttctgaaagcaactggtgtgttgttgatggccggtattttgggagtttgtataaatctatctaacttatatcatacgtatgagtatagtaaggaaacgatgcgtggaaagagtgagctggtgaaaccggatagtcataatcagacaaaaagtggtctggaacgagattatatcactcagtggagctacggtatcggtgagactttctctttgcttgtccctaatgtgaaaggtggtgcttccgtacctttggcagctaacgaaaaggcgatggaaaaggcgaatcctatgtataatagtatctatagccagataggtcagtattggggtgagcaacccggtacatccggtcctgtatacgtgggggcgtttgtgatgtttctgtttgttcttgggctgtttatagtgaaaggtcctatgaaatgggcgcttttgagtgctacagttttgtctgtcctgctgtcatggggaaagaattttatgggattcactgatttctttttggattatatcccgatgtacgataaattccgtgcggtttcttctattttggtcattgctgagtttaccatacctttgttggcagtccttgctttaaaggaggtaatggcacgccctcagttggttaaggaacaggcccggtcgttttatatcagcctgggattgacaggtggcatcgctttattgtttgcattagctcccggtttctttttcccgtcgtatgtttcaagtatggaaatgcaggcattgcagggtattccggcagatcagctggctccgttacttgctaatctggaagaaatccgtcagagtatctttacttcggatgcatggcgcagtttctttgttattatgataggtacggcagttctttggttatatggcatgggcaaactaaaggcgaaggtgacgattctggcattggctgtcctctgtctggcagatatgtggagtgtgaacaaacgttatttgtatgatgaacaatttgtggagaaggtgcagcaggataattcctttaaaccgaccgaaacggataaggcaatattggccgataaaacgttggatttccgggtactgaacctagccggcaatacgtttaatgaaaatacgacttcttattggcataagagcatcggtggatatcatgccgccaagttgcgccgctatcaggaaatgatagaggagcatatcagcaccgagatgaatggcgtgttcaaggctgtttcggaggcgggaggcgatatgcagaaggtggctccgtccggttttcctgtgttgaatatgctgaatacccgttactttatttttccgctgcaagatggaaagactgtcccgatacagaatccttatacgctgggcaatgcttggtttgtaaacgaggtgcagtatgtggataatgccaatgaagagatagatgctttgcatcggatagatccggcaaaaacggctgtcgtagataaaaaaatcagtgcggaggtaaaatcggcggctgaaacagatacactgggtacaatcaaactgactgcgtacgaacctaatgacttgaaatatgaggttaattcgaagacaggaggaacagtggttttctcggaaatttactatcctggttggcaggcatatattgatggtgtggaagcaccgcacggaagagcggattatattcttcgggcgatgaatgtgccggccggaaagcatgtagtggaatttaagttcgatccgaaatcgctgcatgttacggaaacggtggcttttgtggcgttgggtgtattgacctgtgtgctggtcttgttcttattcttgcaggtcagaagagcccgtaggaaaattgattaaggcccgtcgtaagccagactccggattatttgtaaagcaggcgcagaacgaaccataagtggtgtgtcactgtgcttgcccatccatagtgacggctcataatacggaagcgttctttcaaggaggctttatggttacgggtggtcattccttcattcaggtaatcaataagagtaagatgggtgttatggagtacatccgctttcttcatgatacggatacaccagtcaaaatctgccgagaaccgatatctcaggtcatatggttccaccagatcacggcgggcgaaaaaggcttgatggcagactagcattccttgcttgaagcttttccaggtaagcgttgcgggtgcggacaggcggcgcatatataaaaaatgcccttgactgtccacaatttctgtttctccatatagtactcccggcagggctgttccattgatggaatgtaccatttgcagcaaagtatcatcctcgtgcaggccgtcaccggcattcaagaaacaaagataatctccggttgccaattttattcctttgttcatggcatcgtataaaccttggtcgggttcactgataacagtggtgatatgttcctggtatttgtgaatgatatccagtgtttcatctgttgatcccccatctacaattatatactccagattcttataagtttgtgtaacaatactttgtatagtatcctccaatacttttgcggcgttgtaggtgacagtaataatagaaaacttgggatgaggatgatggttatgcatgattccctgtaatcttgttatagatttcaacatatttcttggcgatggtactttccgaatagctggatactgccttacggcaggcttcttcgctcagactttcatattctccttcggtcaatgcccagtgaattccgtttgccagatccttggaagactgatattcggcaacatagccgttgtgcaggtggtcaatcatttgtggaatacctcctacattgaaccctatgcacggaataccacaggccattgcctctacgatggtattgggtaggttgtcttgtaaagaaggtgtgacgtataagtcgactgcgttgtaaatatctaccagttctttctcgttgctgacataattcatcggatagatagggaaaggaaacagggaagcgtattgttcggcttggttgccaaaaaccactacacctaactctttactaaaatcaggatatgaggaagctatttgtttgcaagctgataccaaatagtctattccttttctcttgtctgtaatttttacggagccgaaaagcaataacttcttgtcttgcgggaggtggcatttttctctggcctgttttttatcacgaggtttgaacaggttggtgttgattgcattgggaatattggtaatggtctgacctttaatcagatcacttttcttagccaatgattctaaccagcggctacaagctacaaaggtgatttgtgctccttcaaacagttttttctttttctggaaagtacggtaggctatgtctttcctgcttcctttgtaaagttgtggacagttgtggcattgtgtggcatatttatcgcaatctcctgcatagtggcagataccggtaaaaggccacatatcatgcattgtccaaacgatgggcttgccggattggatgatacgccggatatctgtcagtgacaacataccttggttaatccaatgcagatgaatgacatcggcttgggtaaattcgggcaatgctgtgatattggtgccggtattcgctatgtcaacggcaaacaagttatgtttcttgaagtggttggcttgccagataacgacacgctcccagatgaattgccatactttccaccatgatttctttagttcaacgacacttatctggtcggtctgcttgtcgcgtacaagcatttttgtctttattccgttgttttttaaagcctccatgaggcggttggctgcaatggcggctccacctattcgctcagacgtattgatgataagtactctcatgtgcataaaagtttatgcaaatgtacgctttttaggggacatcttggatatttccagtaagctttctgctatttcacgggaaaagatttccaaattgaaacgtttttctgccagctttcgggcgttggcgcccattttttgggcttcttcgggatggtcggctatgcgatgaatggcattgatccacccttccacgtcatcataggctacggtaattcctatttcttctttgtctatatccatttcaaaattaggattacgtgagcaaatgacagggatgcctaatgcaaaggcctctaccagtgtggtaagacctacggtataaggaaaatccatgcagcagatgacaacacagctttttcgtgccactttctgtgccaacaagtatgggatgacaccgtccgtataatgtactcgtacagaatcgggcagacagaagctttcaataatctgttggtagtttacacttccattggtgggggctatgtacaagtccagttgttgatcggtggcgcagaaagcttgcagcattgtgtctacatcccggttttctttcccggtggagataaaaccttccggtttccgatccggcattgtttgtagaagatggtcatagaaagcgaggtccggcccccaatggataagctgaagcttttcttcgggagcttttccggttgctaatgagtctttaatcaattttttactgaacaggaacatatgatcaatgcccttataaaagaaacgtgagatgcgttctcttatttttctggatgaggtttttaaagcagtgtgatgccaaatgacaatgggcttgcggtagaggcctaatgctctgagtaggatgataagttccaacccacggaaagatgtaccgtagagcacttcgtatggctctttgcagcacagaatctctttagtggcatagagcattagtttcagacggctggggaaagctttgtatttatgcatcaccgaccggattccatatttttccagcaaaggaagtccgtagaggatatgtcccggaaacttataatctttccattcctcgtaactttcacgggttaatcgggtgtgataaaaataaatagtgagtggttttaccggtgttggtctcttttcagccatttgttaattctgttttttattgctttagtgatgatggaaaaattgccgtatcgcaggttcagaaatagttcttcaaaagaacgtcctatcttaatccagggatgtccccaccccataatgcggtagacagcttttttataagctacattctcaatgacataacgaggatgcttgagaggaaattctacttcataccgtttcatggtgaagatgcggcggtatcctttaggcagtgtatgcacagaaccggcaaaatgggtggaatctgccgtggctcccaagttgttaatcatgttgcgggtgggcacgatagccagtcccgagttgaaaagcatggaagcgtggaagatggtttcataataggctttgttgttttctttatggcgatggcacatatagataaagtctttacggaatttccgttctttcatgagctgttccagttgctgcatattgaatgtatcctccagaaaggtataatgctcgtcccattggtcgatgactcttttccagctggcccatccccagatggagaaggtggaggcgaagaaatagtcgtatggtacatccggagtgatctcttcgttattgaaaccggcaatcatggtgatgcgggtatcctgttcgtacctgtccagcatttctttgcagaaggtgaagaaagatacggaaggcacgtcgtcatcttccaatacgatgcatttgtcaaccatggaaaaggcccatttctgtgagatgtattccgaagggtcgcaaccataattcttttcctgatacttacgatgcacttcacattcccagtctatctggtccaccacttcgcggcatgcctttatgccgggcaggtcgcgttcgccacgcggcccgtcctgatagaggaagagcttggagggacgggctttcctgacttgttcaaacacttgcgacaattgttgcgggcggttgaagaacaatataagtacgggtacatctacaagggatggtttcatggttcaatctcctttatttgtaaaattcgagtttgttgtaatgtggatgtatattctctaaatccggtaattgcatataattaccgtatatcttccttagcacagcatctgtttggcgtggtacggggaacatttttccttcaaattccatttctgtcagtggaaaaatatcgtctgtatagcgcggtttgaaataggcggtgccaaaagaatggcgtaattcttttccggggaataacttggcaatgaaccttaggatgggaaaaccgatgcgggtattaaaatgataaattctacgaatccgtttgtataatgtgctttcttttatatttttattattcaactgattgtatatctgcccttgcatgtgtcctcctatccaagctagacaataagggatattttctaaaggaaaaatatcaatgtagataccggtataatggaaaatacggtcatatgaatttgtttcttccaaatgagaatccttatcacgtaatttgccgtatataaagatgtaattgggatctgtttcattagtttgcaatgcaagattgtccggaagttcttgaggaagaactttcagcagacgcaggtaatctgagcgaagcatttctatgtccagatcatcatcccagggaatgaaacctttgtgacgtgctgcacctattagagttccggaactgagccaatagggtatttggtgcttgcgacaaatcacatcaataacctccagaagctctaacatacgtagttgctggcgacggagaagggaaccatcggggttaaatcgctttcttagttcactatccatacattaattttttagtagtttataaaacaaatcagcgttgatgtaacctgtttttgacaggtcttttccttttaattctccttcatggatatattctttgtttaatacatcttgcccccatagcaatattttatcaatgtttggggtacaaatgtttaatacctctgctattgatttgattatcaataatccaaatggaaaatcctcagtgaaataccggcttttgaaatcaggcagaaatcctttttctgttttttccataggagctggaatatgtttgaaggcaatgatggagcgtatcttgcgggtaagtgaccttgcatcataactgtcataatattccaataaagtaggaattggctctattcggaccggcagtgctttcagaatttgttggaattcattgtcacaagcaatgaggagctccgaactttcttcatcccaactattatagaacccgggaatctcatgatatgcttttcctctactccaggtatggaaaagtgaataaagacgggctggatgaagcaatggattgctattggtcaggctggcttctagaaaatgatgaagcatacgcaccggcgtatctaacatttcttgaagagttcgtagtaaaatatcggattttgatatgtttacggtggctatttgtaattcctttttgtatcccaacaagagtgctttctggccataggtttgcacacgggcaatgaatggagcacgctggaatccgaagagtgaagctgttttgcctaatattctataagcggtaaagaaaaaaccggtacaactgactacacttcctatgcaagttttttcctgcaagaacggttgtatgtggagaagttcttcctcaatggcaaatccggggagacaaagcaatacgatatcagagtgtggaatgacttctgccgggttagccgtaacgcaggctaatgagccggagaatgtatttccccggcaatcttcaatgagtaatgatggattccattggtcgggatgccgggtgaggatggaaacattaaagcctttatgtgcagctactcctgcaatgacgtgccccagaccgccaccgccacaaatacagatattgatactcatgcttgcagtttttttaagttttcagccagataattgttgtcttcagtatcgcgtatggcgatacggatgtaattcctgccatcgaatcctgtcttggtactacaatcttttaacaagagattatgctccagcaataaagaaacgagtttggtggaactgaagcgggaagttacttcgcacaggaaataattggcttgtgaaggtatgacacgtaggaagtcaacctgttgcaatacctcgaaaaagcgttggcgctcggctatgaattttttacaggcattttgataatcattattatacttgctgtatatctgtaaatagaattcggcgaaggagtttatattccatatagccatgttttttcgtaaataggatattatctctttgtcggaagatgcggctatccccaagcgtaatcccggaactccataagatttggaaatacttttaatgactgtgaggtgtgggtatgtttccagaacttcattcttaagcagcgtattttcgacacttttttcgctgaagtcaacaaaagattcatccagtattaagtggatatttcgctgctgcgtccatgccagcaaatccataagttcgttgagggggatgaagttacctgatgggttatccggattgatcaagagtaaatggcggatatctttgtccgcataaaaaagcatcagttcttttgccgtataatgaaaatcggcattctgtggatagaatgcaatgatttcttctgattgtcggttgggatattcttcaaaagtgggataaattactcccattttgccatctgaatgttccatcagcgctttgatgatttcggcggctccgttgccaacaaccacataatcttgccggataccgaagttttttgccatgacaagcgtgttcactcccatgccggaagggtattcacggagaagcacattaaaattagcctgtagttcttcacacattttttgtggtggaaaataggggtttactaaatagcagaaatctttcagctttgggaaacgccagtatccgccatatcttttttggtagcgttgtagctggtcctgttcggcaaaaatggtttcagcgatgtcaagatcttgtatatcatcaatctcataccagcgttctccttccaaagggagtcctttcagttcacatctctccagcagggtgattacccgtaatacctgttcgtaatattcgttattacctagggctttgctgtaggcttcaagaaatggcacataactgttgcggagaaactccttactgaatttatagatattgacggttttgtagtaatcgtcaatatctgcgtagcggaacgttttttttgagataaaatcaatgatgtcattttcagtattgagccgtaccatcgtgccgtccatccatggctcatatttagctacaagtgccagattgggataggggttatttaaaattttgtggaaaagtgtatcctcaaaaatcaaatcggattcaattaataaagtatcttgcttttgcaattcctctttagcaagatagagagaatagatattattggtcttattgtagacaggattgtaaatatattctatcggagtatttctactttgtttctctatgtgggtacgtaatttctctccttggtagcctatgactaaaatgatgcgttccagatttaatgaatctaactgtgagagcagacggtctatcagataggtcccgtttactttaatcatacacttggtgttatctttggtaagatctcccaagcgcttgcccatgccggcggctagaatgattgcttgcataataaattaggtatatatattgcaaaagtagtaattaattagcatttataagcgatgttatttatatttgcctcaaattttaaacaggaatgggtaaaataacatttgtaccggtaggaggattggccaaccgtatgcgtgcagtggcttcggcggtaatgctggcaggaaagacgaaaagtgaattaagcatcatttggtttcaggattgggcactgaatgcaccgttttatcagttgtttaagcctgtagacagggaagtggcttgtttacgggatgcttcgcggttggattatgcattattagacagacctcgttccaagaattttcatttcccgcttttgtttcagaaactgcttttcaagtcttgtctgtacgagcgttccattactcctttatgtaaccggcattttgattttgaacggtgggttaaagaaggtggctgtgtttatatggcatcatacaccgctttccaaccttatgattatgcatggatcagtcggttgtttgttccggtagacgagattatggaagaggtagaaaaccgttgtcggaatttttcggatgctatgattggtgtgcatatccgtcgtacagataatctggcttctatcaggcaaagccctatcgagttgttctatcagaaattagatgagaagataaaagaggacggcaaggtggctatctatttggctacagattcggaagaggtgaagcgggagatgaaagagcgttatggcgaccggatattctgttccggaaaaaaggcagaccgtggatctttggagggaataagggagggtatcacggatatgtacacattggctcgtacacaaaaaatatatggttcttttcagagttcattttcggatatggcagctcagataggaggggttccattggagattttgaaattatgagttacggaaataaatcattgttttaatgattatctgcaaacatttttatttttgctcctcttttttctatggcatttgccaatttgttttctatttttcctaatagcagccgtctgctccattctataacaagcgttgtcagacagatagaaacaagtgttcccataaaatacagaacaagtaggttgctgtctgcatatgggacataccagggttgtaaacagtggataagaagtccttgaagcatatataaggcaaaaacgtatcctgctaggtaattgatgatgcgggatgaaaaatgccaccgggtaaactggtagaaaatcatgatggaggcgatgataatcagtagattattatctcgggcgaatctcagtatgatatttccactcattgctgtaagcagggaatttagtataaaaatacaggcaaggctgcctgacaagatttcccggctatgtcgtttcatattttccggaagaccataggtcttcagatattgtcctatgagataagctagtgtgacattgataattcccttgcccgtgtcattctgaatttcaaaaaacaggattgtcggggcaaatacaaaaaagaatccccatagtaacagtagttgtttataacttttttgtgagaggttatgaaccagccggtttaaatagggcgagaaacaataaagtactacatagcaggtcataaaccagtattttttgctaagtatcggtagcaatgaggaggccagccctgtccaggtatgcggagtgtgaagccatattgtttcgatcagataagaaacgatggaataaaaccatacgacaaccagcattttgaaaaatttatgtgtattgaaacggattccaaaataacctgagatcagaatgaacaaggttactccggtgtttcccagtgtattgataaatagtatgaattctttgttcagccagttactggtgtggaaggtatttcctagaatatgcatggatacaatcagtatgatactgataattcgtaaacattctaatccggagtgacgtgtagcagccattatttcttgattatatagtgtaaactctctttaaaagtgacggagccgctcaaccacaggatggctgtgtagagtgtgccggctatgatcattttgcttgccattaataaatacagattggcaaagccgatagtgatataataggtagccgccattaccgcggtagctatgaaggcaaacggaaggatgtctttcagcgctgcaaacaagctgagccgtatttgtttccatacaaaatagtgccatacaaacagccagcagatattgatggatacatacactataatcatggtatgtacgccgtatggatagagcagaagcatggttgttaactggataatgcctaagctgatggtattccacatatagatatccgattttcctttgctgatgactaggttggaatacaaattggttatgggaatgaatgcgccaccgatgcagagcaattgcaggatgaaggcactgggtagccatttgtctgtaatagtcagtataatcagttcgggtgcgattaatgataatcctaacatagccggaaaagaaataaaggcagtgaagcggagcatcttccggaaagcgcgttgttggcgttccctttcatccgacaaactggaaagtacaggttgggccacactgttgactgttcctgaaattaatgaatgtcccatataattccatttattagcttgagtaaaatagcctacttcttgtcccgaatagaatttaccaaggataacggtaaagatattattattgatgtggttgaatatattggttactaataatttgctgctgaaagaaagcatccctctcaaaggcttgaagtcgaaagtaagtgtaggtcgccagggtgagaagcaccaataacagatattaatggttcctacatagacaatgctttgtgtggctatcccccaataggcaaatcccaagcaggccatagttataccgatagttcctgaggcggttaatccgatagtgaccgccattgccttttgcttgaccattaagttgcggaacaggtaagcactgtgggcaatgcccaaactggctacaaagaaaccgaggaaagtgtatcgtgccaaagctgtcagttcgggagtgtgatagaattcggcaatgagtggggcgcaaaggaacagaatgaggtagagacaggcacttagcccggtactgaaccagaatacggcattatagtctttgtgggagatatcccgtttgttggctagggcggccgtgaacccgctttcctgcaaagagcctgcaataagggagaagatggacagcattcccaccatgccataatcttccgcattcagaatgcgtgacaggaatatcccgaaaaaaagattcagcagctgctgtactccattgcttaatccgccccagaagaggccttttgctgtcttttctttcaaggattgttctgtcatttttatagatagattataaaacagtcaggctgaaagcggacgtttcagttgctttcagccttttctgtatttgggtgtatattatttcacttcactgcccggctttacctctcttaataaagaggtcaccgctaaggtgccgtcaaagttttcagcactcaggatcatgccttcgctcaccaatccgttcttgaattggcgcggagcaaggttggcaatgaataaaacttgtttgcccaccagttcttccggtttataatgttgtgcgataccgctgacgatggtacggttctccagtccgtcagcaatcttgaatttcagcagctttttcattttaggcactacctcacactctaatacggtacctacacggatatctaacttttcaaattcttcaaaagcaattaccggttttatcgggttagctttatagttggcagcctcgtttgctttttgggtagccaacagtttgtctacttgtgcttgaatggtttcatcttcgatcttttcgaacaacagttctgccttattcaattgatgtccttctgccagcagatcggtacgccccagttggtcccattcaaatgtttccatattcagcatttggcggagcttttcgctgctgaaaggcaggaaaggttcgaatgcaatagctagattggcaactagttgcaatgctatgttaaggatggtggctacacggtccatatcagtttttgccagtttccaaggctctgtatcggctaagtatttattaccgatacgtgccaggttcattgcctctttttgtgcatcgcggaatttgaatacatccagtagcttttctacttctgcctttacgtctgcaaattcttttaatgtttctttgtcgtagtcggtcaattcaccgcaaacgggaactttcccgtcgaaatatttatgagtcagcactaaagcacggtttacaaagttaccgtaaacagccaccaactcattgttgttacgtgcttgaaaatctttccaggtaaaatcgttgtcttttgtttcgggggcattggctgtcaatacatagcgcaatacatcctgtttgccggggaagtcctgcaaatattcatgcaaccatactgcccagttgcgtgaagtggaaatcttatcaccttccagattcaggaattcattgctaggtacgttatccggtaagatatagcttccttccgctttcagcatagcagggaaaacaatgcagtggaatacaatattgtcttttccgatgaagtgaatcaaacgggtttctggatctttccaccaagtttcccaactgtcgggaagtaattcttttgtatttgaaatatagccgatgggggcatcgaaccatacataaagtacttttccctcagcgccttctacaggaacagggattccccaatccaagtcacggcttaccgcacggggttgcaagcccatatccaaccagcttttacattgtccgtatacattggggcgccattctttatgattttcaagaatccattcacgcagccatccttcgtgtttgtccaatggcagataccaatgtttggtttcacgcatcactggtttactgccactgatagcacttttcggattgatcaggtcggtcggagaaagtgatgttccgcacttctcgcattggtcaccgtaggctccttctgcatggcagtgaggacattcaccggtaatataacggtcggccaggaactgatgggcttcttcgtcgtaatattgcatggaggtcttttcaatgaactcacctttatcatacagggttttgaagaattcggaagccagttcgtggtgtgtctttgatgtagtacgagagtatatatcgaatgaaattccaaattctttgaatgattcttttatcaaggtatgatagcggtccaccacatcttgtggagtaataccttctttctttgcacgaatggtgataggtactccgtgttcgtcagagcctccgatgaaaagaacatcttcttttttcaggcggagatagcgcacgtagatatcagcaggaacatatacacctgccagatgaccaatatgtaccggaccgtttgcgtagggcaaagcggatgtgacggtggttcttttgaatttattttccattgtatgatgtcttttttgttatttctaccagtaacgtgcaaagttagtgatttttagtaagtatatggaataatcagaaatatttctcccttaaaatctctgacaggccgtacttattataaaatatggttattcgggggctttgtcggaagaagtgaaaatacagaaaaatgttatatcgtgatgcagtgatttgcacttatttgcatttaatcttaaggagagaaaaatgatgaactaaattttacttatcctgttttttataaaaccttaagtcgaacgagacatgaatacgtggtataaattcattttaaatgcacttttctctaaaaagagagaggataaagattgggaaacgaccgatagggaagaggatgttctttcaaattacattgaactggactcattgatgcaggtcatttatcatgcaaaggaaactgagtcgggcagctaaactaaccggcccagtcttctctatcaagatttctatagcttatcgcttctgctaggtggatggaagtaatgtgttcgctgttgtccagatcggcaatggtacgcgctacttttagaatacgaccgtatgcgcgcgccgacaggttgaggcgtgtcatggcagttcgtaataattttagccctgcttcattgggttgagcgtacagatggagtaacccggcttccatttgtgcgttgcagtaaatacccggatggttggcaaaacgttgagcttgtattttccgggccttgataacccgttcgcgtatgcttgcactactttccgcatgatggcgttctgccattttttcgaatggaaccggaactatttctatttggatatctatgcggtccagtaaaggaccggagatacggttcaggtaccgttgcacttgtccgggattacagacgcaagctcgtgtgggatgattataatatccgcatggacagggattcatactggctaccagcatgaaactggccggataatccagactgtatttagctcgtgcgatggatatatgcctgtcctctaggggttggcgaagtacttcaagtacacttctgttaaattccggcaactcgtctagaaagagcaaaccgttgtgagccagactgatttctcccggttggggattggtgccgccacctaccattgctacttgcgaaattgtatgatggggactacggaaaggccggatggcaatcagtgaactgtcttttcctaattttcctgctactgaatgtattttagtcgtttccagactttcacccaatgaaaggggagggagaatgcttggcatacactttgccatcatggacttcccacttccgggtgaaccgatcataatcaggttgtgtcctccggacgcggctacttccaatgcgcgttttacactttcttgtcctttcacatcagcaaaatcgtatggaaagctactttggtgttcatagaattcctcccgtgtattgacgatgctaggctccagattgcgttcattattgaaaaattcgatgacctctttgatattttctacgccatatactttcaggttgtttactacagcagcttcccgcgcattttgtttgggaagtatgaagccttcaaaaccttgctcgcgggcactgatagctatggagagggctcctttgactggttgaaggcttccatccaggctaagttctccgataataagataacgtgaaagtttttcttccgatacgatttgggtagcggccaatattccgattgctagcggaaggtcgtatgcagacccctccttgcgtatgtcggcaggggccatatttactacaatttgacaagtggggaatttatatccgtttacctgtaaggcggaaataatacgttcatgactttctttcacggccgagtccggcagaccgacaaggaagaattttatacctcgtgaactatttacttcaatagttacaatggtagcgtcgataccttgaacggctgctccatagacttttaccagcattcttttattttttattttgtctctttcgagcacgttctgcctctttggcggctttttctttctctttatcttgttctgtcagctgtctcactttgtctatcagttctttgccccgtatatcttgtgtgatgacccgcttgtcaggacctatcagtatattggcaggaatccgggttatgccttgttgcttgacaatggaattgttccagcctttgaaatcgcaaacttgtttccattgcgtggtatctctttgaatgattttctccatccattcctttttatccagatcaagggagaggctgataataacaaacttgtcttttttcaatgccttttgtacggatactaaagaatcttgtgtggcaatgctttctttgttccagcttgcccaaaaatccaaaaggacatatttcccttttacactgttccagttgacggtctttccttttttatccgtgcacgaaatgttggaaacgtagcgatgttctgtcagttcttttttctcgcttaatttattctggagttctataatataaggtgtgtcttttataataccgcttagtccttttatcagctgatctatgtggttgtaatcaggaagcgagtcctgtacgtaatatttgtctatcagatagatattgctgtacgagcttgggttggttttaatcaacgaatccacagcagtcataacagctgccttgttattttctaaggtgctaaggtactggatatgttttgccagttgtgcgttttctccctttcctttaacctctatctttccggccattccgtttagggtaacactttctcctttatcagcatatatcggtaagatttgtttttctcccaatagtaatgagaagatagtaaatgtgtcaggggtaatggtgtaagtgaatttaccttttgagaggagtatggtatccagcttgtaatcgggttcttgataaaatactaatatagtgtctgaaggaagtcctttaatgcttccttccaaggtgaatgtatttttcttgccgcagccgcttgccagcacaacaagagtgaaaagaaagaatagtaattttttcatttcaagatattttttgcgaaaatacgcattttgtggctaaaggcaggcataaatgaaggttattttacataaaaagaccggaagcttcatcacgaagcctccggtttcagtcataatcatctaaaaaactagacaagatgatatctagttatattatttgatagcatcagcgtatttagcgaactcgcgatcgttagcagctttttcagccattgaaggatcttttgcgattgcgctcttgatgctgctgcttaccaatgaagcattgtttgtgcgagcaccaacgatagccatcaagtagtcagtcattgcatccggattcttgattgcagacaaagtagcttttgctttgttatagtctttagccaaaatctgagcttgagcggcactgttagtcttagcgtcaccgaatgagttgacagctctgtcatactggccttgtttgatatataagttacccaaagcttcgccggcagcgttagcacctgtagctttgcctaagtaagtttcggcagctgcaacattgcccttaaccaattcgcaaagaccaaggttagcgtttacttcaggagcgttagcgttcttagaagcagcttgtttgaagtagctttctgctttagcagcatcaccggcagcgaatgccaattcacccaagttattataagcacggaaatcgttcggataaagttgagttgtcttggtgaagatagcttctttgcgagcgttgtcgttagtcagggtagcagcgtacaataattcttctacactcaatactttaggatcagagttgaatgcttcgttgatttcgtcatcgctacgaccgatgatgtcatagttggcagttaaacgggcacgacgcaactgaggcaggatttcgtcagccaaagttttgtatacagaagagatattcttgatttcagcttctctttgttcaggatcattgtacatagaaagaacacgtaagatcaaatctttatcctgcaagtttgatttagataccagttcttggaagccttcccagtcttgtgcagtgtattttgcatccaggttagtatcaatcttgcccttcttcaactggcgttccatatatttttctgtgtttgcttcacggttttcagccaaaccggtgttcagttccacaccaccatcaggtgaagcgtatgcagaaatttcaatgttgttcagtttgtagttctttgtgtcggcattgatttcagccactttcttatggaattctttgatatcgtcagaattcaattcgctgttgcgcaagttggcttgctggatcaagaacatgatgttggcagtctgagcatctttaataatgcgttggaaagcatcgttagcgtatgatgcgttagagctggcagcagtaggcagttcagaagtcgcgataacgccatcagcgattttcacagaaggaatagtgtatgatttctttccttttgtaatcttgaaatcaagataaagttcagagtttgccatttcgggaacatagtcgaaagaagctttcatcgtgtagctgccacctgccttgtaagcgatagtctgattgtttccttctactttttctccttggaatacagcgggctggcctttagcttcgccgcctttccatctcagaacgggggtaacttcaacagttgcgttcttcttgaaatacttttcggggaatttaccattaattgtcacaggcactttaccaccgattgcttcaagcacttcagggttagttgtgaaatagtcagaagacaattctcccatcttgccgcatgatgataaggcaaggaccaataaagccactaagggcaaatacaactttttaatcatagttacttattaatttaacgtttgtaatgtaaaattcgctatagtacgtttttgtgcgtctctttggggacaaagataggaaaaactctattatatgctagcttcttagcctgcttttttttcaatttatcttaaaatattttagaatatagaacctttattatctttttctctgaatttgatgttacgggggtgatgttctatgatttcactgcgtagcatattacggtctatatgtgtataaatttctgttgtcccgatactttcatgtcccagcatacactgtatggcacgcaagttggcgcctccttccagcaaatgtgttgcaaaagaatggcggaatgtgtgaggactgattttttttttcagacctatccgggctgccagttctttgatgatatggaaaaccatgatgcgggagatgttcttcccgaaattgctgataaagacaaagtcttcaaatcccggctttattttcatcaggttacggtcggtgaagtagagcctgatttccttgatggcgcgcggtgaaataggaaccagccgctgtttgctaccttttccttccactttgatgaagccttcttcaaaataaagttcggataatttcaggttgcagagttcggaaacgcggagcccgcaactgtaaagcgtttccagtatggccctgttgcgctgtccctctttggtgctgcggtctatgcttcctatcagcaggtctatctcttctacagtcattacttcgggcagtttgaaacctgtctggggggattccagcaattctgtcgggtcggctttcaggtaatcttccataatgaggaaacggtagaaagagcggatgcccgacaagatgcgtgcctgcgaacgggggtggatgccgatatcatgtaatccggccgagaaatcttccagattttcaagccggacatccagaatgttgatgttttctaatgtaagataagccagtaacttgtccaggtcagtaagataagcatctaccgtattgtcagataacgatttctccaactttaaatattgtttgtatttcaccaatatcttgtctgttttctcggttcttttcatttcttttttctacctttgtacccaaattccctgcaaaggtagaaaaagttcagatatagtataaatatgaaaatacaaattattaatggacctaatatcaatttattaggcaaacgggaaccttccatttatggcgctgtttcatttgaagactatctggtggaattgcgccgtacttatccggacattgaaatagcgtattatcagtcgaatgtggaaggtgagatgatcaacaaaatacacgaagtgggttttgattatgacggcatcgtgttgaatgcaggggcttatacgcatacttccattgctttgcaggatgctatccgcgccgtgacagctcccgtggttgaggtgcacatctcgaatgtacatacccgtgaggagtttcgccataagtcgatgatttcctgtgcttgtgcgggggtgatttgtgggttcgggcttcattcatatcgtttggcgattgaggctttgttaatgagaaaataaaacgtttaggtataatataaggtgataagattatgatgttgaaacaaacaaaaatcgtagcgtccatctcagatcagcgttgcgaggtagagtttataagagatcttttcaaggccggtatgaatgtggtccgtatgaatacggctcacgcatcgcgtgaaggttttgaaaaattgataaccaatgtacgtgaggtttccaaccgtattgccatattgatggacacaaaagggcccgaagtgcgtactactgctattgcgggcggcgagcctattccttatcagattggtgacaaagtgaagattgtaggcaatcctgcacaagaaacgacccgtgaatgtattgctgtatcttatcccggttttgtgcatgatctccaggtggatggcgatattctgattgatgatggtgatctggagctgcgtgtgattgagaagacagacgagtatttgttgtgtgaggtgcagaatgaagctactttgggtaaccgtaagagtgtaaatgtaccgggcgtgcgcatcaatctcccttctttgacagaaaaggaccgtaacaatatactgtatgctattgaaaaggacattgatttcatagcacattcgtttgttcgtaataagcaggatgtgctggatatccgtcagatactggatgcatacggcagcgacattaagattatcgccaagatcgaaaatcaggaaggagtggacaatattgatgaaatattggaagtggccgacggagtcatggtggctcgtggtgacttgggcattgaggttcctcaggaacgaattcccggcattcagcgtctgttgatcaaaaaatgtattctggcaaagaaaccggtgattgttgctacccagatgttgcataccatgattaataatccgcgtcctacccgtgctgaagtgaccgatattgccaatgctatttactaccgcacggatgcattgatgctgagtggggaaacggcatacggcaagtatccggtggaagccgtgaagacgatggccaagattgcagcgcaggccgagaaagataaactggccgagaatgacatccgtattcctttggatgaaaactccaatgatgtaaccgctttcctggcaaaacaggcagtaaaggctaccagcaaactgaatatccgcgccattattaccgacagtttcagcgggcgtaccgcacgtaatattgctgctttccgtggcaaatatcctgtattggccatctgttataaagaaaagacgatgcgtcatctggctttgtcatatggggtggaagctatctatatgcccgaaaaggctaacggacaggcatattatttcgctgctttgcgtaaattgctggatgatggtgtcttgagtgaaagcgacatggtggcttacctgagcagcggcaagcaaggtactcagacttctttccttgaaatcaatgtagtgggagatgtgttgaagtatgctatggactatgtgctgcccaaccgcaaccgttacctataataatagaagataggaatgaaagaaacggacgctattgacgaatatatccttcagcacattgatgaagaaagtgattatctgaaggcactttatcgcgatacgcacgtcaagcttttacgtccccgtatggcttccggccacttgcagggacgtatgctgaaaatgtttgtgcaaatgatacgcccccgtcaggtgctggaaatcgggacttacagtggctactccgcactttgcctggccgaagggttggaagagggggccacgttgcacacatttgagataaacgatgagcaggaggactttacacgtccctggctggaaggttcgccttacgccggcaagattaaattttatataggtgatgcgctgaagttgctgcctggcatgaacattacctttgatttggcgtttgtagacggtgataagcggaagtatattgaatattacgaaatggtactggagaaattatcacccggcggatacatcattgccgataacacattgtgggacggacatgtattggaggaaccgcatcatacagatcttcagactattggaataaagaaatttaatgatttggtagctgccgacaaacgggttgaaaaggtgattcttcccttgcgcgacgggctgacaatcataagaaaatgttgaataatgtgccaataggttatgctatgaaccgtatggcatattaacaaattagcaaactgaataattattaattatggaaacgaccagacaaaataagatttctcgtttgatccaaaaggagttgagtgagattttcctgcttcagaccaagtccatgaatggtgttttggtgtcggtaagtgctgtccgcatcagtcccgatatgagtattgcacgtgtctatctcagcgtgttcccttctgagaggagccaggaaatagtaaagaatatcaatgataatatgaaatccatccgttatgaattaggaacacgggtacgccatcagttgcgcatcattcccgagttgaaattctttgtggatgattcattggattatgccgaacgtatagacgaattgttgaaaaagtagaaccgggcggtgaattttcccttttatatagcgaagcgttatcttttttccaagaagtcgcacaatgccattaatgtcatttcagccatttccgtctgcggagtggctttggctacattggcattggtatgtactttgtctgtttttaacggcttccaggatctggtggctactttctttacggcttttgatccggagctgaaaattacggctgtcaccggaaaggtctttgacggacaggaagcgcgtatagaagctttgcgccggatgccggagatcgctgttttttctgagtccttggaagagaatgcgatggttcagtataagggccgtcagactatggcggtgatcaagggaattgaggataatttcgaggatctgaccgctattgacagtattcttttcggccgggggcaattcgtgttgcatgatgaagtggtggattatgccattcccggcatagaattggtttccatcttgggaacgggtatcaaattcctcgatccgctagagatttatgctcccaaacggggagctaaagtcaatatggccaatccagcttccagctttaactctgccgatttatattccagcggccttgtgtttgcggtgaaccaacagaagtatgactcttcttacattttgacttccctccaatttgcccgtaggttgttccagtatgacacagaagtgagttcggtagaattgaaattgaagccggatgcagatgtagggagtgtaaaatcgaagatacagaaaatattgggagatggtttccgggtgcaggaccggtatgagcagcaagcggatactttccgcattatggagatagagaagctgatatcttatattttccttacctttatcctgatgatagcttgctttaatgtaataggctccttgtccatgctgattatagataagaaggcagatgtagtgacattgcgcaatttgggggccagcgacaagctgatcacgcgtatattcctgttcgaggggcgtatgatttcactgataggtgcggtggttggtgtgatactggggctgatcctttgctttatccagcaggaattcggattgctttcgctgggaggtggtaattccggcggtaattttgtggtggatgcctatcccgtcagtgtccatgtatgggatattgttatagtctttgccactgtgctggtggtgggctttctttccgtgtggtatcccgtgcgttatctcagccgcaggttgctgggcaggtaatttatttattattgttgatacggctgatgtttgtcggtttgtacggtacggcttggctgctttctttgtttttattcttttcgtcttttggccttatggctttatctggttaagtcttttcttctttgtggttaaccttgttttaccttatggttaagctcttttttatggttgtgtactatagtctcttgcggtggtttgtacagtctgatatagtggactgtataaactcttgcagtagactgtacagtccactgccggagtctgtagtagttaactgtatgataagggttagctataaggaaaaacgaccttaatcgtcggagcaatagggcttggtacaagcttctttccagggcgtttcagatcttctactttcagggtcctcaaatcaattcgtagctgctcacctgaataggcatatccagattatgcagcaccttctccagcaaaatgccttcccgattatcatattcatagccgaaagtggcgcggatgccttgaaggataaactgtgtggcgcggtccaaggcgataggaagactgtcgccttgtatcagtgagccggttatcacactggtaaatgtatcgcctgtgccgggatagtgtgcgggcaggtagggacacgttactttccaatagcggtttccctgtctgtcataggcgtaaacggaagttttgcgaggatctccctgtacgggcacgctggtgataataacgataccggggccgtgctccgaaatttcatgcaggtaagcttttagttcttcgtctgtattctccgctttatagggtttgtccagcaaatagaacagttcggtcatattgggcgtgatgacatctgctttccggatgaggtgacgcatttccagaatcatttgttcgtcaaaattggtatatagctttccgttgtctcctaatacgggatctatcatgaccaggctgtcggactggcggaaatcatcaatgaacccggatacgatttgtatctggcggggagatcccaagtagcctgtataaatagcatcgaattgtacgccaagttgtttccattcactgataatcttgggcatctcgtccgtgaggtccaaaaaagagaagtgcgggtattgggtgtggctcgataatacggctgtgggcagagggcagacttgaaagcccatggatgagaggatagggataacgacggtgagggatacgcgccctgcaccggacagatcgtgtaccgcagctatcttctttactttatttgtatacatatctttatgaattaagcgttatggatggtatatataacaggtaaaccggaagaaagttattccaatgctatgctttttacctttatgtcttgccggcccaagaagatggaagcggattcctcaaacttgttttcgctttctgtggtgaggaagcggcagtttcctcctttatcgcagcgtgcgtccatttccggatggcggtttaaatagtctcgcaggctccgggccacatattccccttgtgaaatgatgcggataggttcaggcgtaaattgccttattttatccagtagcagcggataatgggtacatcccaatataatggtgtcaatcatcggatctttatccagcagccggttgatatgttgtttgacgaaatagtcggctccttccgattgatattcattattctctaccaaggagacccacatgggacaggcttctcctgttaccacaatgtcgggagataacttatgtatttccaaaagataggattcggatttgatggtaccggctgtggccagtatacctacgtgccggcttcgggtgatttctcctatacattctgctgtaggccggatgacaccgagtactctgcgggtagcgtctattaccggaagattgatctgctggatggtgcgtaaggcttttgccgatgctgtgttgcatgccaatatcaccaaaggacatcccagttcaaacagtttgcttacggcttgcagggtaaattcgtaaacaacttcaaaagagcgcggtccgtacggacagcgtgcgctgtctcccaaatagatataatcatactcaggcatcagtccgcgtattttgtccagaatggtcagaccgccgtagccggagtcgaatacaccgatgggaccggttgaagggaggatagatgggatcatggcagtatagctatataatacaggcacggattacacggatgttcacggttctgaaacctgtgaaatctgtgtaatccgtgcctgtaaaggtccttaacttaattatttgattcctactttagctttgacagcagcagttacatctgtagactgcgcttcatttacgtagggaatttctgttctgttcaaatcgaagatataagtatatccaccttcctggcctactgctttgatggcgtcttcaattttcttgtagataggttccatcatatcagcgtatgatttctgcaactgttgttgtgcatcttgttggaactgcattcctttttcctgtaattcctgcaattctttctggcgtctttcctgaatgttcttaggaaggttggcttgttcctgttgatattcagtatattttttggtcagttcatcagttgcacgtttcatttcatcctcgtattgtttctgcatggcttggatgtcggtctgggcctttgtgaattccggcatgacagtaagtacatctgcggatttaatatgcccgaatttctgagcaaatacactcatcggagcgataagtaaaagtagtaaagcaatttttttcaacatagttctattttttattagttattgcaaatttggattatcggttgcaaatgtaggaaattaatttgaatatcctaatcttgagagcacttcattgctgatatcaatgcttggagatgcgaaaataatgctttgggcggagcctctgtccactactgccgcatatcctttttgctctgaaatctgttttaccgcttcatagattttatcttgaattggtgtgatcaatgcctcttgttttttggccatttctccttcgggaccgaaatatttctttctcagttcggctgcttccttttcttttgctacaatcgcttcttctctttgcgttttctgtgcggccgacagggaagccgaggctttctggtattctttataaagtgcttccgcttcttttgcttttgcttccacctcactttgatattgttgtgaagcttgattcagttgggtattcgcctgttcgtatgcaggaatattcttcaggatatattccatatcaatcaaggcgaacttttgagcgctggctgtgaatacacaagccacaaacaatagagataataggatagcctttttcataatcacattgtttttagttattaaaactcttgtcccaggataaagtggaactggcttccactatactggctggatccgttaatcttgtcgaaaccgtatgcccagtcaatacccatcataccaatcatcggcaggaagatacggacaccgacacctgccgagcgtttcaactggaacggattgaatttgcttacatctgtccatgcgttacctccttcaatgaagcctagtgcatagatactggtcgaattttccagcatcaacgggtatcttaattctgcacctaaacgtacgtaagcatagccttcactaccataaggagtcaatgaaccgttttcgtaaccacgcagtgcaatggtttcggaagcgtagctggtgctatagcctgtcataccgtcaccacccatatagaatgtttcaaaaggtgatttcttgtacttgttatagtgacccagcaaaccgaactctgcacgtgtcatgataaccggacatttctgacctcctgtaagagcggtataggtctttgatttgaatttccatttgtggtattcaatccagttgaacatacttgccgcttcatcataatcatctttaccgtataccgagtagtccttgttactgaacaatgagtacggaggagtcagctgtacggaagccgagaattcagaaccgcgacgcgggaaaatcgggttatccgtagagttacgtgccaaagtcagattcaaactcaggttgttgcaattaccggttgacatgtattctccgttgttcaacttgatatacaagtagctccagtctttcaaaataaagcgctggtaagaaagttcggctgacaaggtaaaatagtcatccggccatctcaaacgcttaccccaaccgatagatgctccatacatctggatagatttatcggggtcataaaaagactcgtagttgttattatatccgccataataatttccataaccgctgtaataattgtagtaattattcatataagctgagttatagtagttactgctgatatctgtctgtatggagtagaaagccgaaacagagaatgaattcggacgttttccgccaaaccatgggtcaaagaacgatacactatatgactggtaataactaccgttggtctgtccgctgatggttaatgtctgtccatcaccctgtggcaggaatccgcggtagttgtcactcttatggaacaagttggccatagagaagttcgtgaacttcaaacttaatttaccgataacaccggtttgtccccaacctgccgagaattctacctggtcgtttgctttggactccaggttccagttgatgtctaccgtaccgttggtcgggtccggttgtacatccggctggatattttcagggttgaagtgtcccatttgggctatctcacgataagaacgttccaatgcttctttgctgaacagatctcccggcttggttcttaactcacggcgtactacgttttcatacaaacggtcgttaccgttgatacgcactttgctgatagaggcctgaggaccttcctgaatacgcatttccaaatcaatggagtcgccgtctatgtttacttctacggggtcaaggttatagaaaacgtatcctttattatagtagtagttaccgatagcatcttcatcaccggtcagacgctcggtcattaatttctggttataaacatctccctttttcatacggagctgttcgttcagccagtccgaagcataaatggtgttacctacccaggtcacgttgcgcagatagtatttgtcaccttcttctattttcatgtacacgtcgacggtacggtcatcgtacggagaaacactgtccacaacaatttgtgcgtcgcggtaacctaattcgttgtatttgtcgatgatatgctgtttgtcttcttcgtatttctcttcaatgaattttttggtacggaaaaggttgacaagtttgtttttctcattcgtcttcttcatgacgcgttttaacttcttgtcacttaacacggtgttgccgtcaatggtgatcttgtggactttcaccttttctttcttgtcaatcatcacatcaacatccacttggtccttattgtcagccaaatcacgctcaacgatggtcacttcggcgtttttaaaacctttttcatcgaaatgtttcttgattaatattttagcacggtctatcaagttgggagtaatctggcttccttttaccaaacctagtttggcttccaaatcttcacgctcgcttttctttacgccgtggtaacgaatgtcggcaatacgtggacgttgggccaggatgatttttaaatagatcttgtctccaacaattttttcagctaggatttgtacatccgagaacagtccgtgtcgccaataacgttttacagctgtggtgatgtcatctcccggaacaacaatggtctgtcctaccgatagtcctgaaagtccgatcaatacataatcttcatagttttttacgccttctactttgattccgccgatttcatacttcttgggcgttccggaataaagtatgactggattgtcgttttcttctacgtttgcttcttgggcgtaactgcctgttgaaaagcaaaataggcatgtaagcgttaatagtataagtgaaatacgatatagcattttatctaactttatatttgttcactggttttgccgaaacggcgttctcttttctgataatcataaatggctttgcaaaattcttcttcgcggaagtccggccagaacgtttcacaaaaatatagttcggaataagcacattgccaaagcagatagttgctaaggcggatttctcctccggtacgtataagcaaatccgggtcgggcatatagtttgtacttaaatgtgcacttatcaaattgtcatcgatgtcctcaatggctagtttgtcgttttgaatcttggccgctatttgtcttaccgcttctgttatttcccatttggaagagtagcttaaagcaagtgtcagacacataccggtattgattgaggtgcgttcaatgcattggttcaatcgttccagaacttctaccggtaactttgccgtatcaccgataatgcgaaaactgatgttgtttttcatgaaagtttcttcttcaatggagtccatcagaagactcatcagagcagcgacttcatctaccggacgattccagttttcggtagagaaagtatatagtgtcaagtatttgactcccagtctagccgcttcttctgctatgatgtgtacagtttctgcaccggcttgatgtccgaagctgcgcgcctgtccacgttgtttagcccatcttccatttccatccattataatggctacatgggcaggtatacggcttttgtctatttgctctctatatggcatgtcgcaatctattttatatgactctctttgactttattccttggaatcgaatcccaacttattgattcgtcctctccatacttctccgcttcggctccatataatccacaagaagttattcttgtctacaacataagaatagttgccgtctgcctggttgtatagatcagtgaattctgtagggaagaatacatatcttgaaacaggtttccatgtaacgccttgatccgttgatccgtagaatcggctgaaagcgggaatgtccttaccgaaacttttacccggaccaccgaaagcgtataattggtcgttgtaatgaatcatggctatattagccagcttgggacaataaaaactatcgtatgcggctgtaggataatctgcccaactgtcttctgtagtcagtctggtccatacagtagaggtcgtgtcggtcgcaatgggattttctcccattagtaccatacggtctatgaatttattggttaccaacgggtaagctgtgtatgataactgatttttcgggaaattggccggaacctcgccattagtatcccaaaccagagcatccgtgctttccataaaatgattattggtgtctatggcgtacaatttgcagttatgttctgaatgaacgccggcaatcagcttctcgaatttggtgttagtgcccatcttgctccagctttttccgtcagaggagcagtacaggtcattgtcggcaagtatgtataattggtttccccatgccatgacagaagaatagtccgcattttgcatattttcaggtaaagcctgtaagggcgtccaggtttttccgtcattgatgtgggtgcttgtaacagcggcgccattgtcttgctgtgcgaaaacataaatataatcccctaatgtgactgctttctgtgcttggatagtgttgtcgaaactacttcctctatggctccactgcaatgagtcgggaacttgtttatgtacattaatctcggctttataaataggtccatagactccgctcatcgccataactttaaattggacaggcttttcgaaattcaaggagtcggtatcattccacaacgaatctttgtcctcagcgacaataaaaatgccaataccgtctgatattatgctgactacgactttgctgatgtctgtaccgactggcagggagtctacgttgtaaatatgtcttgtgccttggtcgatggcaaaagggtatttggtaccatcaacggtgaatgtcagcgttgtgtctttgccattaaccttttcggtatattgagtttcaattttatcttttatagcaaaagaggtaatgcttgattctgaactatattctgtttctacttcgttgtcgtccaagcaagatgtaatcatgaaagccgcagcaagcagacttgtgatgacagtcaaaaactttattttcatttgcaaatgagtctattgttacaagtcgcaaaagtaggaagatttttttctatatagaagttttgggacaagttttatattaatttatagataaaccagccctttttctcggtcaatcagccacattttatctttgaatttgtgaatggacggcatgcattatttctcttccaaagtatattttattcagtttaaagtgttttttttgaatagaaggtgcctgtattccattgtttaagcgtagtggagccttttctatgaaggcttcatcccataagccggagtctatgaaagactgtaataaaatacttccgccttctactaggagtgattgtatttttttctgatataatacttccattatttgcggcaggatatctttgttgaaatccaacgatatgtattctgttaatgcgtttggctgacagggggattcccgggtaaacacgaatgtctttattttgccgttgaaaagttccaaatctcggggtaatgtcaattctttgtctattaccagacgcacgggatgcttgccgtaccaattccgggtggatagggagggattgtcaagtaatgccgtgtgtcgtcctactaatatagcgtcatgttcggcgcgttttttgtgtaccagcatgctggtcagcggattggaaagtatgatcggctttcctcctgtgcggtttatatcgataaagccatcagcggattctgcccactttaaggttatgtatgggcgtttgagcgtgttgaatgttatgaagcgtcttatcagatgccggcattcctcttctaagacgcctacggttacttcaatgccggctttgcgcagtttctcgatgcctctgccggctacttgggaaaacgggtctatgcagcctattacgactttggggattctcttctctataatcaggtcggcgcagggaggggtctttccataatgggagcatggctccaggcttacgtatatggttgattccttcaaaagattttcgtctttaacggaacgtatggcgtttacttcggcatgtgcctctccgcaacggatgtggtagccttctccaataatggtgtcgtgatatacaatgacagcacctaccatcggattaggggctgtgttacaaagtccgttgtatgccagttgcaggcaacgggaaatatatttttcatcttttgtcataacgatcttgtttaaattcttacttttgcatataaaatgacactatgaatcctgttgtatcttacataaaacaaaccttgcagggatattaccctgattcagaacttgtgcctatggctaaattgctgcttacacaagtcttcggcatgtctgttgttgaattgtatgcaggcaaagatactactttttcggtgaatgagcggaaacagctggatgatattctggttcgtctgcaaaaactggaacctattcaatacataataggtacggaagaattttatggccttacttttgaagtgaataaacatgtattgattccacgtccggaaacaggggagttggtagactggattatacgggagcataagtatggtcgggttagaatattggatattggtacggggagcggctgcatcgctgtctctttggccaagaatttggaagaggcggaggtcgtttcatgggatgtttcagaaaaggcgttgcaagttgcggaacgtaattgcaggcggaacggcgttcgtgtaactcttgagcaaagggatgtgctgcttgcttctcctgcaggtgagcggtttgatgtcattgtcagcaatccaccttatattacagaaaaggagagggaggatatgagtgctaatgtcttggaatgggagccggaattggctttgtttgtaccggatgatagtccgttgctgttttatcggaaaatagcagaattgggtagggatatgctagtgtctggtggaaggctttattttgaaattaatcaggaatacggtcgggaaacggtggatatgttggctggtttggaatacaaaaatatagaattgagaaaagatctctttcaaaatgatagaatgataaaagcggagaaataagatgaagggagaattaagtgagaatgatttgaagtataaggcagaagcttattgctcttcaatggagcgttgtgtagcagatgtagaggctaaattatcacaatggggagccactccggaaatgatggagaaaatcgttcggcatttgcaggatgagagatacattgaccagaagcgtttttgctcggcttttgttcgcgataaatatcgctttaaccaatggggcagagtgaaaatctgccaggctttgcgcatgaagaaaatccctgcggatgttatagccaaaggattggaggaagtagatgagcgggaatatatggagatactatctggtttgatcgagcagaaaagaagaagtgtgaaagcatgtacggaatacgaacggaatgggaaattgattcgttttgcagttggtagaggatttgaaatggaggctgtttgccgttgtgtgaaacaaaccggagaagatgatgtctatctggactgatctttggaatttatttttccctcatagttgtctgctttgtgggcggcagcttatatcaggggagagagtgctttgcttgaaatgcttgtcggggcttccgcgtactcaatttcatttacggaaagataatattgtagaatgtaatttctggggaaaaataccggtggagcatgccacctcttttctttattatgcaaagggaggaaatgtccgacagttgttgtacgaactgaaatatcatggtaatcaagaagtgggtgaagtgatggggcggatgatggcatctgaacttatgtgttctcatttttttgatgggatagatttgattgttcctgttccgttacatcaacgtaaaaaacgtttaagggggtataaccaaagcgaatgcctggcaagaggagtttcggtggtgacaggtattcctatggatactaaagttgtgataagaagcaggtatactgacacacagacgcataaaggacaatatgcaagatgggaaaacgtgcgaaatttgtttgcctgtattttccctggcagcttggaaggaaagcatcttttgttggtggatgatgtgctgacaacaggggctacggttgtttcttgcgctgatgcctttcgtggcatacccggattacgtatcagtgtgcttactttggcattggcaggggaatcctgataacaacaactattttttagaaaaataccttgtccgatttttcattatctcgatgtatttctatatttttgcacaatatttatcagatatagttgagttatgaagactttagaaaaattattcgcagagaaattactgaagattaaggctatcaagttgcagccggctaatccttttacttgggcgtccggttggaagtcgcctttttattgtgataaccgcaaaactctttcgtatccttctcttcgtaattttgtgaaacttgagattagccgtattgtcctggagaagttcggtcaggtagatgctattgccggtgtggcgacaggggctattcctcaaggagctttggtggctgaagagttgaatctgccgtttgtgtatgttcgttctactccgaaagaccatggcttggaaaacctgattgaaggtgaacttcgtcctggtatgaaagtcgtagttattgaggacttgatttcaactggcggcagcagtttgaaagctgttgaagctatccgtcgtgacggatgtgaagtgattggtatggtcgctgcatttacttatggtttcccagtggcaattgaagcgttcaaggaagcaaaagtgaacttggttactctgactaattatgaagctgtattggattcagccttgaagaccggatatattaatgaagaggatgttccggttttggataattggagaaaggatccggctcattgggaggcaggcaaataagttatagttttaaaacaaatataatatgaagagaaccgttcgggaatttttatggatttccggattgttcttttcgtgtttttagagagcaggtattatggcacaatttgagagtggtgtgaaatatgttccttatagtcaggaacaggtgtttaataagttgtcggatttaagtaacttggaatctgtacgtgataaattggccgacaaggtacaaggtatggagttcgacagtgactctttaagttttacggtacaaggcataagcattactttgcgtattatagaacgtgaaccttataaatgtgttaaattcgaaagtgaaaaatctccggtccctatgaatttgtggattcagattttgcctgtagaggctgggcaggcaaaactgaaagtaactattcgtgcagaagtgaatatgtttatgaaggcgatggttgctaaacctttacaggatggtgtggataaactggctgagatgttatcgatgattccttattaaaaataaagacaaatatggcacagaaactttgggaaaaaaatgtccgggtaaatgaggagatagatcgttttactgtaggacgtgaccgtgaaatggatctttatctggctaaacacgatgtattgggctcaatggcacatatcaccatgttggaaagtatcggtttgcttacagccggagaattggaaatgttattagcggaattaaagaatatctatgcttctgccgaaaagggagagtttgtaatagaggatggtatagaggatgtacactcgcaagtagaattgatgttgacgcgtaagttgggagatgtcggaaagaaaattcatagtggacgttcacgcaatgaccaggtgttggtggatttgaagctgtttactcgtgcggaattaaaagaagtggccgaagaggtggagcaactttttcatgtgctgatttctcaaagcaatacatataaggatgtgttaatgccgggttacactcatttgcagatagcgatgccttcttcatttggcttgtggtttggcgcgtatgctgagagtctggtggacgatatgatgtttctgcaggctgcattcaaaatgtgcaaccgcaatccgttgggctctgctgccgggtatggttcttcttttccgctcgatcgtgagatgaccacccgcttgttgggatttgattcgatggattataatgtggtgtatgcgcagatggggcgtggtaagatggaacgtaatgtggcttttgctttggcttctattgccgggacagtttctaaaatggcttttgacgcttgtatgttcagtagccaaaactttggctttgtaaaacttccggatgaatgtactaccggctccagtataatgcctcataaaaagaaccctgatgtctttgaattgacacgggcaaaatgcaacaagctgcaggctcttcctcagcagattatgatgataatgaataatttgccttcggggtattttcgtgatttgcagattataaaagaagttttcttgcctgcgttccgggagttgaaggaatgtctgcaaatggctgcctatattatggacaaaattaaaatcaacgaacatattctggatgatgaccgttacctttatatctttagtgtggaagaggtcaaccgtttggcgtctgaaggtatgccgttccgtgatgcttataaaaaggttggcctggacatagaagccggcaagttcacccatgacaagaaggtgcatcatactcatgagggtagtatcggtaatttgtgtaatgacaggatcgaaagcttgatgcggcaagtagtggacggatttaatttctcagtcatggaacaggctgaacgaagccttttaggtagatagaaataattgtaaaacgtaatagcatgaaatatcaaccttcggcagaccgttatagcaaaatgcagtacaaatactgcggaaatagcggcttgcttttacctcgtatctctttaggtttgtggcataactttggtagtgtggacgattttggtgtagcaaccgatatgattaaatatgcttttgatagcggggttacacattttgacttagctaataattatggccctgttccgggaagtgctgagattaatttcggtaaaattctgaaggagaatttccaaggttaccgtgatgaattgattatttcctcaaaagcaggacacgaaatgtggaatggaccttatgggggaaacagttcgcgtaagaatttaatggccagtatcgaccaaagcctgtgccgtaccggtttggattactttgatatattctatagtcaccgttatgatggcgtgaccccggttgaggaaacgatgcaagcgttgattgatatagtgaagcaaggaaaagcattgtatgtgggtatttcaaagtatccgcctatgcaggcaaaggtggcttatgaaatattgagaagtgccggtgtgccgtgtttgatcagccaatatcgttatagtatgtttgatcgtgctgtggaggaggaggtattgccgttggccgctgaacaaggctccggctttattgcattttcgcctttggcacaaggattgctgaccaataaatatttgcatggtattccggagcactctcgtgcggctcgtgctactgggtttttgaaagtagaccaagtgacagaagataaagtggaaaaagcacgtcggctgaatgaggtggctgtacgccgtgggcagactttggctgagatggcattggcatgggtgttgaaagacgaacggatgacctctgttattgtgggggcaagttctgtaaaacagctggcagataatcttcatgcgttggataatttggcctttactgatgcagaattgaccgaaatagagggaattttacgattgtgaataaaaaaatgggtgtaaagtttggttggtattataaaatggcttatctttgcacccgttaaaacaaaacgcggaaatagctcagttggtagagcataaccttgccaaggttagggtcgcgagttcgagtctcgttttccgctctctctcgtcgaggatgctcgaatggtggaatcggtagacacgagggacttaaaatcccttggccattgcggctgtgcgggttcaagtcccgcttcgagtacaagatgtaattgcaatcattggaaaactgatgattgcgatttttgttttgtataattcaccataagataacggaagcagaagcagggtcaacgtaacaatctgagggattttatatttaagcatataatttagcaagtcattcagtaactttatagccaactccttgtcggctatcgcggcatactgcttttttgaaaagaagcccgccattgacgtaaagtttgtcaatgacggacaacttgctattttttgattttatttcgaactcacgttaagatacaaaaaattagggagacgggcaagttctgactgagcgaagttaggacttgcccgatttttttgcaaacacaaaaaaaggccgtctcattttgagacagcctcttgttggtatatgggaagaatagtttttcatttcttcagtaccttctttatcaactctataaactcttttccgtatttttctttcttatattcgccaataccattgatgttgccgaatgcttctattgttgtaggttgttgggtggcgatcaggtgcaaagtcttgtcggataaaacaatataggcaggtatagcttgctggtccgccagctttttacgcagtatacgtaactcctcgaacaagtccttgttttcattaccaaaagtaaccggagtgggaaagagtacctcttccttggctttctttttgcgtttttccttagcaggtacgaattcttcccgtttaatgactaccagcatggcggattctttgccgaacaatactttttgcccgctttcagttattttgaggtgattgttctcattataggctatttcgaaatatcctagattcagcatttgcagcagataatcttgccagtcgcgtgcgggaatatctcttcctgcggcatatgttttcagtttgtcataacctttgtcaatcagttcttggtttgctgaccctttcaatatgtctattaacatgtgagtacctatttgttggttagttcgggctattgcactcaaagctttttgtacaatgattgttccgtcaaagcgttcggggggattacggcacacatcacagttgccacaatcatggtccatggtttcaccaaaatagttcagcaggatacgcctccgacagatatccgattcagcatattgttgcatccggtgtaatttctctaagttaatttcctgctggctgctttctgtagcgaatttggaaagcataaccaagtctcccagtgaatagaacagcaaagtatcactttccataccatcacgcccggcacgtcctatttcttgatagaaactttctatgcttttaggaaggttataatgaataacccagcgtacattggatttatcaattcccatcccgaaagcaatagtggcgcacaccacctgtacacgatcatttatgaaatcattttgtgccttatcacgcatatcgctgcttaatcctgcatgataaacggttgcacggataccttgtttcatcagcattgcggccacattttctgttttgctgcggctcatgcaataaatgataccacattcatttttgtgtttttctatgaattcaagaatagtccgcatcttatccttttgttggtagcctcttttaacttccaaactcagattgggccgatcaaaggaagatatgaatattttaggatctttcaaggccaattgttgtacaatgtcttttcgggttattttgtcagctgtagcagtcaatgctacaatcggtactttgggaaactgattacgtaatacctttaattgggtatattcaggccggaaatcatgtccccattgtgagatgcaatgagcttcatcaatggcaaataaagaaatttgaatatctttcagcaggaagtttgtttctataagtaatcgttcaggtgaaatataaagcaatttgatttttccttgaagacattcgcgacgtagatttatattttctgtttcattattgctgctgttcagtgcccgtgctgcaattccgtttgcttgtaaactttccacctggtctttcattaaagaaataaggggtgaaacgacaatggccgtaccttccatcagtaaagccggtaattgataacagatggattttcctcctcctgtaggcattaataccaaagtatccttttgagctaatatattttgaataatatcttgctgtaaaggacggaaactatcgtatccaaagtagttttttagagtttggaacatatctgtttgttattttaaaatgtaatcggttacaaaggtagtaaaatctttagatttggtaggaatctctgcctaataatagtaaataagatatacttttattcataattcatttgttttgaaattattgcttaaaagagaggttggttattgtagattggacaaataaacttttttgccacttaaaaaacaaagtgttgtgattatttaagaaataaattaagcaaaaaaagttgcatatgaaaaaaacttttcccacatttgtccaaaattagatatttgcatttatataactaaccaaacaacgaaaaattaaaagaaaaattaactgatgagcgacgtggaaaaaaaatcagaaacccaggaagcggctcctaagaaaaaaccgtataacctgagagaaaagaaagagaaaaaggctgcttacagatctctgattagagcagaacttgccgatgaattgtatgataagattttgaacattgtagttgttcagaaaaagtacaaagaccctaattattcagcaaaagacttggcgaaagaattaaagacaaatactcgttatttgtcagctgtagtgaattcccgcttcggaatgaattattcttgtttgttgaatgaatatcgtattaaagatgctttgcatcttttagttgataaacgctatatggataagaatgtggaagagatcagtgcaatggtaggttttgctaatcgccaatctttttatgctgcgttttataagaatgtgggtgagactcctaatggctatcgtaagagaaatcaagaaaagaaataagagcataatttgctacattataattaagaaaaaggaaaacaattgttttcctttttttgtttcggctcacgaattatgtatctataaaaaacgttaattgtagaaatgaaacaggttggttgcaatgaagtagataaaagcatgaatgaaatggaggaatttgattatacggttgaacaatttgccgacttacagttacttcgatataaagtgtatggatttgaagaactgagtttgaaacaaaaaaagttgatttactatttgtcacaagctgctttgcaaggccgtgatattttgtttgatcagaatggcaaatacaatttgcttattcgtaaaatgttggaaaccgtatatacagagtatcagggagatcgtacagatgtgaatttcgtcaatttggaaacttatctgaaacgcatatggttttctaacggaattcatcatcattatgcttcaaataagttcgtaccaggtttcactccggaattttttagggatgcattgaatagtgtggatgcattgaagttacctttgggtaaaggggaaacagtggaagaactttgtgaagaagtctttccggtgatttttgattctgaaatgatgcctaaacgtgtgaatcaggcagacggggaggatttggtcctgacttcggctgcaaattattacgaaggggtaacccagaaagaagcggaagatttttatcataatttgaagaatccggatgatatgatgccggtaatgtttggtatgaacagccgtttagtaaaggaggacggaaaagtacaagaaaaggtctggagatctggaggattgtatgggcaagccattgataagatcatttattggttggataaggctcttggtgtggcagaagatgcacaacaaaaaatagttatcgaaaaattaattcgattttataagaatggggacttgaaagattttgatgaatattctattgcgtgggtgaaggatttggattcacgcgtggattttgttaacggctttattgaaagttatggagatccgttaggactgaaagctagttgggagtccattgtgaattttaaagatctggaagcaaccaagcgcacggaaatcatcagcgctaatgctcaatggtttgaagatcactcacctgtagatcatcggtttaaaaaaaaggaagtgaaaggtgtgtcggccaaggtgattacagccgctatgctggggggggatttgtatcctgctacagcgattgggattaatctccctaattccaactggattcgtagtgtgcatggttctaagtctgtaaccatcggaaatctgactgaagcctataataaagcggctcatggtaatggatttacagatgaatttgtttgcggtgccgaagagaaagaatggataaagaaatatgcagatcttacaggggatttacatactgatttgcatgaatgtttggggcacggttctggccagttgttaccgggagtagatcaggatgctttgaaagcgtatggatctacgatagaagaggcacgtgccgatttattcggtttgtactatctgccggatgacaaaatggtagagttggggcttacaccggatggagatgcctttaaagcagaatattatacttatatgatgaatggtctgatgacccagttagtccgcatcgagttaggtaatatggtagaggaagcacacatgcgtaaccgccagctcattgcgcggtggacatttgagaaaggtgctgcagataaggtggttgaactggttaagaaggatgggaaaacgtatgtgaagataaacgattatcaaaaattgcgcactctgttcggacagttgctggctgagatacaacgcattaaaagtgaaggagattttgaggctgcccgtaaattggtcgaaaagtatgcggtgaaaatagatccggttttgcacgccgagatattggcacgttatgaaaaacttcatctggctccttacaaaggttttgtaaatcctgtatatgaggccgtgacagataaggatggaaatattatagatgtaaaagtatcttataatgaaggttacgcggagcaaatgttacgttatagcaaagaatttgcgaatcttccttatagaaatgaataagaataaatatggatgtacacgaaacaataaaggacataaaggggcaattccgtttgtttatgaatggggtggtttcccaaagtatgcgtgagaagggattagactataaactgaattttggcatcgaacttccgcgtttgaaagaaatagctgctcgttatgaaaaaaatcatgaagtggcgcaagctttatggaaagaaaatatccgtgaatgtaaaattctggcgggaatgttacagccggtagaaacattttatccggaaatagctgatatatgggtagaagatatgcgctatcctgaaatagcggaactgacttgcatgagtttgttccaatatttaccttatgcttcggagaaggcttttgaatggatggccgatgagcgtgaatattttcagttatgtggctttatgctgatggcaaggctgttgatgaagggaaatcagctgactgagcgttcggaagctgaatttttggatcaggcaatggtcactttacaaagcgagggagtgctgccccgcaaagcagctgctactgctttgaagaagtttgccgttcaaagcaaggaaaatggcaaaaaggtgaatcggttgttggctccattaaccaaatcagataaggtagaaatagcttctttggctggagaaataaaattagaaacagaatattggcattaaactttcatgttatcataaaaaggcttaactttgacggcggaactgaaatctgtgatggaagagaatgtgaaagataaggtaaagcagatcttgacagaatatctgcaggttaacgggcatcggaagacacctgaacgatatgctatactcgatactatctattccattaaaggtcattttgacattgatacgctttataattatatggcaaatgaaggaaaattccgggtaagccgggctactctttataataccatcattctttttatcgatgcaaaattggttattaaacatcagttcggcaattcttcccagtacgagcgtgcgtacaacaatgaaacccatcatcacatgatatgtacggaatgtggcaaagtgaccgaatttcaggatgagaatctgaaacaagccattgccaatacgaaactgaagaaatttcatgcctcgcactattccttatatatctatggtgtatgcagcaagtgtacttgggccaagcgtaggaagaaaaaagataagtaacataaaacgaagaaacatgaaagtagatgtcttgttaggtttgcaatggggtgatgaaggcaaaggaaaggttgtcgatgttctgactccccgttatgatgtggtagctcgtttccagggaggtccgaatgcaggtcatacactggaattcgaaggccagaaatatgtgctccgttccattccttccggaatatttcaaggaaataaagtaaacattattggtaatggtgtggtactggatccggctttgttcaaggctgaggctgaagctttggaggctagcggacaccccctgaaagaacgtttgcacatttcaaagaaagctcatttgattttgcctactcaccgcattctggatgctgcttatgaagctgctaaaggagatgccaaagtgggaactaccggaaaaggtataggtcctacttatactgataaagtgagtcgtaacggtgtacgtgtaggtgatatccttcataattttgaagaagtgtatggaaaggcaaaggcacgtcacgaacagatcttgaaaagtctgaattatgaatatgatataaccgaactggaaaaacaatggttggagggtatcgaatacctgaaacagttccatttggtggacagtgaacacgaaataaacaatcttctgaagtcgggtaagagtgtgctttgtgaaggtgcgcagggaacgatgcttgatgttgatttcggttcttatccttttgtcacttcttcaaataccatttgtgccggtgcttgtaccggtttaggtatcggtcctaataaaattggtaatgtatacggtatcatgaaagcgtattgtacccgtgtgggggcaggtcctttccctaccgaattgtttgatgaaactggtaagaaaatccgcgatttaggtcatgaatatggtgcggtgacaggtcgtgaacgtcgttgtggctggattgatcttgtagctttgaagtattctatcatggtaaacggggtgactcagttaattatgatgaagagcgatgtgttggatgatttcgaaaccatcaaagcatgtgtggcttataaagtaaatggtgaggaaattgattacttcccttatgatattagcgaggggctggaacctgtatatgcggagctgcccggatggaagactgatatgaccaagatgaccagtgaggatgaattcccggaagaattcaatgcgtatgtcactttcttggaagaacagctggaaaccccgatcaagattgtttcggtaggtcctgatcgtgatcagactattgaacgctatacggaagaataatagagaagaatcttataagataaaaagagatactgttttcctttggaggcagtttctcttttttttgtatacatctatctgtttctatgtatatttgataaaattgtaacatctataatgatacccatgtaagataatatatctttcgtctttatcgtatatcttcccggttactattttaagatgtgtgtggagcatcaattgtgcattattgcgtattattgtgccaaatcgcgtcattccgtctgggtttctttctatatttgtcatcaataaaaatatcgatatggcattacaaacaaccggattggaatttttctacttgagtgtggatttctccgagaatgataaaatattgttggtggaacaagagttgggctacattgcttgtattgcatttattggcacgtatttaccacaaaggatgtctttgctgttggagagaggataggtgtctgctttttacttgcagattgtccgaaggatgtacggccgattatgtacagcaagtagtggatgcactgttggaacgtggattttttagtaaagcccaatacgaaaaaaatggaattcttacttcggaaagtatacaggaccattactttgaggcgatacaacaacggaagtgtgtagaggtgagtactgattacttgttgatagagatttcaaaatacaagaatttgtatgtggatggtagtaacgtaggcatttcaatggaaaatgtggacatgaaaacatgaagttacaaaataaagcagagcaaaaaaagaaaaggactcctcttcattttgttctccagaaaagaagaggatttttgcggagaaagagactttttcttctattcctgtagatggaaaatgcagaaatgcttccggaccagttgaagctttgcagcagtgagggataggagataagatagtagggtactgtgattatggtgtgatagggcatccgatatggcaaatattagctgatatgcgtatgtcaggtggaaggttatatcaattgttagcctttattggggcgcgcctgcgagtttgaccgattagaatttagtagattgataaatactgtaattgtgtaataaagaaaacgattgatcgttttatggttcatataagtagaaaataaatagaatattaaatagataatagcctgatttttagagtgctgattatgctaatggtagagtataagtagaaagtgactaaaaaaatattcataatatattgtgtatcaagtaaaagggggaaataatataagtatggtggacttaatgaatagaggagaacggtaagcataagttcttttggaactcattttatcaataatattgcaaagatataaaattttattaaaaataaaagaataagtctattattttttgtctatgatatttttttattcataagtattgtttagttgtgatatttgttagatgtaaggtagttattttatttttagtataaaatgatgtgaaatacatgaaaattgtcaagataatcattttcttcttcagatatcttgttccaaataaagtaccttgttttttatttctttaactatttatcctttgtgtgaaattactcttttaacagttgaatattgtttggaacgactaatatttaggcgttttttataagaaatgaattcttgtactttcctcttttatagaactaagttccaaaagaacttggataatgtttaattaaaagagagtgagtatgaaagaaaaagtgttaatgttactagcttgtctgtggttgggtatcggcttctctatggctcaagcgcctaaaacagttgcaggagttgtaacttctgcggatgatggtgagccgataataggtgcgtctgttttagtggaagggactactatgggagcaattacggatgtagatggcaagtttgctatcaataatgttcctacagatgccaaagcgctgattgtttcttatctgggtatgattactcagcgagttggaattcagcgtggtactattactgtaacaatgaagtcggacacaaaagtgttggatgaagtggttgtaactgctcaaggattgaaccgtaaacaaaaagcgttgggttattctacacaaaaggtggcaggtgaggatctaactatttcacgacagaccgatttgggtaatgctatggccggtaaagtgtcgggagcacgttttataggtggtgccagttctggttttgatgcaggtactattattttgcgtggtgcaggttccattccttcttcgtcccagtcggataatccggccaatgagcctatttatgtggtagatggtgctatcaccaacaaaaactctatcaatatggatgatgtggaaagcataaacgtattgaaaggtcccgcggctactgccctttatggttcgcgtggtggtgcaggtgctatcatcataactactaaggcgggacaaagtgagaaagggttgcttgaagtaagtcatacattgcaggccgaaacttactataatcatttcaatatgcagaagctgtatggtggtggaggatatggaggtacggaaaaaggtaacagggctcaggatatttatgatttgtatagtggtgatattcccggtttgcaaggtgcttatgtgtacgattataatgaagatacttcttggggagctgcatacgatccggctgtgaaatatgtcactccattatcattagacgaaaccagtggtcattatggaaaaccagccacttggcaacatggattggatttgagagatctttatcggactggtgtaaccaatacaaccaacgtttcgttttcaaagagtgtgaaagattttaatacccgtgtttctttcaccaatagctatcgtactggtgtgcagcccaattcggatgctattcgccgtttcttagggttcaagacaaatttcaaacccacaccgtggatgaatgtgtcattggattataaatatacttatcgtcaggatcataatgctgccgaaagtggatataacggttcacgtaccgttttgcaggaatatacccaatggggacagaccaatgtcaatttaaaagattataaggactataaacgtccggacggatcatggaggacatggaatatcaacagtgtgaataatcaaagtgctgcattccatgataatccgtatgctttatttcatgaatataatcatcgcaccatttatcaatggaatgtattcagtggtgatgtgtctgtggaccttccttataacttgaaggcaggggtacgcgtaaatggtaacatacgtggttacaaattggaacgagaacgcccttcaggatctattaatttccggtcaaattatcgtcaggatcaaagcagtttgattgatttgaccgtacaaggacgtttaacttggggacaatcattttttaaagataaactaacggtagacgcagctctttttgcagaagcacgtgactatacgtacgataatttatatgcatacaccaatacgaattatgatttgtctttggacgattactataatttggctgcttcatcgggtactattgctttagcctataatgagaaaacacattacaaagaacgtagtgtttatgccacagctaccatgggctgggatgatacttattttcttgacgcttctgttcgtaacgatatgtcttccacattgagtcctaatcataacagctattggtatggtggcctttccgcttctgtccttgctcacaaatgggtgaatgcagaatggctgaacttttggaaactgcgtgctagtgcggctcaagtaggtactacgctcaatgcttacaatatttatcctacttattcgctggataccagttatggttcacatgttacaatgtatgaaccttcttctcagaaaaattataatatcgagccgtctatttccacttcgtatgaaataggtacggaattccgtttgttcaataatcgtttatggggtgatttcaactattatacccgggatgacaaagatcagataatctccgtaacctctgctccgcaatcggggtattctactcgtaagatgaatgctggtttaattcgtaatcggggtgttgaattgagtttgggcgggatgcctgtttccactaagaactggaaatgggaaatgaatttcaatatagcgaagaatagtaataaactggtggaactagctgatggagtggattcttattctatttattggacttcattcacaactcgtttgtataattatgctatggttggtaaatcacttggtgtgataaccggtaatacatgggaacgtgatgacaatggcaatataatcttccatgaattgagtgcttcgcagaaggcgttgtatggtggtgaatatgtacctacttacaatcagaacactctagatgaactgggtaacttccatccggatttcactggtggttttaatactagtatcagttttaagaatttccgtctgtcggctaatattgatttctctgtaggcggacagattgtatcctatactaatatgtggggtagcagtagcggtattcttgataaaacagctgaacttaatgaccgtggcgtcaatgttcgtgaaccggtaagcaaaggtggtggtatccacatgactggtgtggatcagaatggcaataaggtagatacctatgtcaatgctaaactatattataccacagcttcccgtgtatgggaagaatgggtgtatgaccgtacttacgtgaaacttcgtgaagtgtcattgtcgtatgttttcccgtcacaaactttgaagaaactaaatatcggtctgagtcgtgccagtgtggcaattaatgcttccaatccatggttgatctactcagcttgtcctaatgtggatgtgtctgaaattggtatgggatattttgaaggtggtaatgccgctgcaacccgttcgataggttttaccgttaatcttgctttttaaaccataaaacgaagaatcattatgaaatatattaaattattacttttatctctgagttttgcagcaacattcacagcgtgtgatatgactgactttggcgatattaacaaagatcccaatgaaccgtcggaggctaatactggtatgttgtttacatacgcttgtacttatgtgaaatacttctctatgaactcaaattattattacccgtggacgcaaatgtatccggggtatatgtccgagaaaaataataatcagtatggtgcgtttggcggacctactatgagtacaagttcttattatctttatccgttgaagaactgccagaagattattgactttaatagtgatgaggctgaaaaaggtaaacctgccattgtacagtttggtgataatgctaatcagattgcggttgcacgtacattgatgggattcatctatatgcaccttacagatgctctagggccacttccttacacagaagcatttcaggcaggtgaggaaaattttactccggtatttgattcacaggaaacgatttatgctaagttagatgccgatttgagggaagcgtataatcagtttaatgaaagtggctcgttgagcacagccgacattctgttcgatggtgacattcgtgcatggaagaaactgaatgcttctacccgtatgatgcttgctataaaactggcagatgtggatcctgccgaaggacgctcgcgttttgctcaagcttacgctgatggcggtattgaagaaaatgcctataatttgaattatacttttgaggccaatactgtgggatatttatattataatggcgtaaaccataattataattttgttcctaataagtattatgtagatcagttgaaggaattgaaggacaaccgtctattctctacttgttcgctgattccttttggcaagacacaggcagaggcgggcgtgacggatgaagacctgaagaattttgataaataccaaggtatgcctttgggcattgagtctgcagatgtgaacacgtggaataaagtctgctgtttttataatccttctctcacacaggtaacctctactttccctattattactgcttctcgtatgctacttatcgaggctgaagctgctcaacgtggctggattcaagctgatcctgcccaactttatgcagccggtgtgaaggcatcatttgaacaatggggagccgaaggtgttgatgaatatttggcacaggaagcagttgcttatacgggtactgatgctgataaaattaataaaattgctcttcagcgctggatcagtggcttcatggctgatggttttgaggcatggtctgactggcgtcgttttgatattccgaaactagaagtcggtccggtttgtacaacgattgatcacatcccttatcgccatcaatttgatagcgaaatttatcaaggtaatcttgaaaattatgaagctgccgtgaaagcagatttgaatggtgatgatagccgtgagcaacgagtctggtggaatagaagataagatttgaagtatataattctctttaaagtttcgtttaaatataggggacattctcagtgatgagagtgtcttcttttattgaaataaatcaaaaaatatataggataaacgttagttaagactaggtaattcataaattgcctcgatggatagatatacgtattgctttttcttattgacttttgttgtgttcggttgggtggcatttgaagaatgctattgttgggatattgaatttttatgaagaaattctcctgttttaaagcataaaaaaaggctatctatcccagacagccaatcttttgttaaccttaaatctaatactatgaaaaacacattgcaaagatacggactttgtttataatagcaagtttttagtctgtatttcgctgttttataacatgctttataaatatatcgcaccttgttaacaaattaatttaaaaatgtaaagttttgtttattatgacctttcggactttttgtcttatgaatgatagaagagggcaaatgaaaataaaagtatgtgatagctgtttttctatttcttattttatatctttgatgtcactttactgattgaaaaaataacagttacttatgaaaaacagacagtttattgtatttgctcttttattagcatgtccgttgctgttacacggacaggaaacgtttctttgtggaaaagaatcatgtaataaaggttatatccggcatccatggtatggaaaaaaggttggttatataggagactcgataactgatcccaattgttatggagatagcataaaaaagtattgggattttttgaaagaatggttggatatcactccttatgtgtatggagtgagtggacgtcaatggaatgatgtaccccgtcaggcagaacaattgaaaaaggagcatggagaagatgttgatgccatcgtggttttgatggggacaaatgattttaatagcagtgtacctgtcgggacttggtttacagagaaagaagagcaggtgatggctgcccgtggtgaaactaaaaaactggaaatgcgtaaaaggcgtgttcctataatgacgaatgatacgtataaaggccgtattaatattggtttgagtcatttgaaaaaattgtttcccgataaacaaattgttttgttgaccccattgcatcgttctttagcggaattcggcgaaaagaatgtacaaccggatgaaagctatcagaataaatgcggagaatatgtggacgcttatgtacaggccattaaggaagcaggtaatttgtggggagttcctgtaatagattttaattcggttacaggtatgaatccgatgattgaagaacaacttatttatttctatgattcggggtatgatcgtttgcatcctaataccaatggtcaagaacgtatggcacatacattgatgtatcaattactttctttgcctgcatcattctgacagttggacattcatattttgcctttttggaagagtttgtctattggggagaaccttcgatgtttcgatatgaatttgaagaattgaaaaaatgttcaagtggcaaattgatgttgtttgaacatctttttattagttcttatttactgaaagagtaattgaactattgattttgagcaaatttctatattcttgtatcattttttatggtttcttttcttgtttacttttgcctaaatcttttaacttataaaatgtatatgaaaaacatgaaattaaaagtattacttgttttatgtgctttactcctgttatcggcttttattgctgagagaaaagcccccattactatttttatgattggtgattctaccatggcgaataaaagtctgaagaatggtaatatagagcgtggttggggacaaatgcttcccggatattttacggaagaggttgtggtggataattacgctatgaatggatgaagttcactcagttttatcaatgaaggacgttgggatgtagtgctttctaaaattcataaaggtgattatgtatttattcaattcgggcataatgatgagaaatctagagtcacattacatacagaatccggaagtacctttgatgataatttaagacgttttgtgaatggaacatgtgctaagggaggaaatcctgtactgttcaattctatagttcgtcgtaatttccccccccctaaaggtgtgacggagataaagggtagttatgaaaaagaaggtccggtattggttgatacccatgggaaatatctggaatctccccgtcgggtagccggagaaatgaatgtatcttttattgatttgaataaattgatccatgacttggttaccggtatgggagtcgagaattcaagaaaattgtttatgtggattccttccggacaatatgaattttgtccggaagggaaaattgacaatactcacttgaatatatatatatggtggacgtctagttgccaggttggttgtggacgctttgatggaagaagtgccggctttggcaaaatatgtgcgacgttatgattatgtggtggcgaaagatgggagtggggatttctttacagttcaggaagcagtgaatgcggcagttggtggtggcaagaaaacaatatctatacttgtccgtccgggagtatatgaagagtatgtttctatgccggaatcatcgcctcgaatagaattggtgaaacagacaggggctgagatcagggataacgggttcacacaagatgtttatgtggcaccttataagggtgacagagtgtgtgctatcagttatcatttgataagaacagggtaggtacatgtaccgaacaatatcccatcgggggagataagtcgaaatcgactcctgtgtctttagataaatgggtggaaagcttggtaaactccggtagatagggagttggcaatgatacatggaatatcgcagggatatgatgcttttcaaaatcctaaaatattgtgggaataaggtaaaggctatggaaaatgaaatatgggtgggtacatttagagaggtagttgcctatacaaaagaacgagaaaaaaatcgcttgaatgtgctagaaaacggctatgacataactcctcatttgatatgaatgcacaattatttacagaaccactgactatggtattaaaatctgtgggaaacagagtttaggagattaggcaagatgggaaaaagctttttctaaagaaggatgctgataaggttcttttcgattttaatctttatggagtgatgattcagattcgttttatctgaggtgttggatatagttttaaaactagaatagggaaatccgttagtctttattgtaaccatttgaggtgtgataataagattaacggatttgttttttgctcttttataaagttactcagaattaatttctaaatttgttcccgttaactttattcctttttcaaaagaaataaaatggaaaacacagagaaactgattgtagaacaactgaaaaatggcaacgaagatgcttataaatacatctatgattatcattatgttcttttatgtcatgtagcaaatcaatatttgaacgataattttttatcggaaactatagttggagatgtaatatttcacctttgggagatcagagaaactttaaacattactatttctattagaagttatctgataaaggctgttcgtaatcgttgtatagactatctgaaatctagatctgaaaaaaaggaaatttcattttcagttttagtaccggaagagatgtctgaagaaaagtatttgcagtcggataattatcctttgggaatattattagaacgtgaattggagcatgaaatccgtatggcaatagataaactaccggttgaatgtagatgtgtttttgaaaaaagtagatttgaggagaaaaaatatgaagaaatttctcaggaattaggtatttctataaatacggttaagtatcatataaagaatgcattatctttccttcagactgaattgagcaaatatttaattgctttgattttatttttttcgtgttaaaacagaaaaaagttcttttaggactaccctgtatttaaaataaatcgtcttcactttagaaacaacaaagatgaaagcagaaaaagaacatattgatgaattaatagtatcctatttaagtaatgagttggatggaaatgctgtgcatgaactgaaggagtggatagctgcgtctgtggaaaatgaaaagtattttatgcagcggcaagaaatttggttttctgccataagtgtgaaagaggatgttaaatatgataagagcaaagcatttgaacaatttaaaaatagaattgctaatcagaggttgaatgataaaagagaacgtgaaaatttctgtttgtctaaattttggcgttatgcagctgttattgttgtattgttctcagtttcttatttttcttattggaggggtggaataagtataaaagaggtattttcggatatcattgtggaggctcctcttggttccagaacaaaattgaccttgccggatgggacattagtgtggttgaatgccggatcgcgtataacatattcacaaggattcggagtagggaatagaaaaatagaattgataggagaagggtattttgaagttaaacgaaatgaagaagttccatttcttgtgaaaacgaatagtttgctggtaaaggtattgggaacgaaatttaattttcgggattatccggatgatgcagaagccattgtttctttgtccgaaggaaaagtggcattgaataatttattgaaaaaagaaaaagaagcttttttgttacccaatgaaagggtggttttgaataaaaagaatggcagaatgcatgtggagtattctactgtttccaatgcattacaatggactaatggatatttattttttgatgaggaattgttgccggatgttgtgaaggagttagaacgtagttataatgtgaaaatacaaatagctagtgatactttgaatactttcaggttctatggaaatttcgttcatcgtgagcaaaatattcaggaagttttggaagcattatctgcgacccgtaagattcattatattattgaaggacacaatataactttatattaagtagggagtggattaaaattgtttaaccttaaaattaaaagtatgaatagaattagagctgtaatactgtaataggggtacgaaagggatgaaaaagaaaaggtgggaagatatagggattttcccaccttgatgaaatctctttttcgacttacgattgtgagtgcgcttttagagaatgcaaagttaatgatttttctctttaaaagctaagttcatttaattttttaattaataaattactaatttatgaaaaacaagagaaaggccatattattggtcggggctttgctttgccttaatttgaatatcttctcacagaatataccattgaaaatgaataaagtatcggtgaaaaaagctatgactgagctaaaagaaaaaagtggatattcatttgtgtatatagctggggatttagatacgaaaaagattgttgatatagacgctgagcaactgcaagaagttattgagcaaatcttggaaggacaaaatgtttcttatgagataaaagataaaaatatcattattcggaagaaggaagtagaacagtccatgttgaacgagaaaaaattacaagatatttcagggcttgtgatggatgttatgggagaacctatcgtaggagttaatgtgatggaaaagggaactactaatggtactattactgatatgaatggtaagtttttacttaaagctcctgcgaatgcaactcttattattagttttatcggttataagactcttgctgttaatttggaaggggaaaagaatgtgaatataactctgaaagaggatttggaacaattagatgaagtggtggtggttggttatggaactcaaaaaaaatctagtttgacagcatccgtggcgacagtgcctgcaaaagaactgagtaaacagatggggcattctgttgcagctgctttgcaggggagggctccaggagtagaaatattgcaaaaggggggagaagctggggcagatatcaagatacttgttcggggagcaggtacatttggtgctactgaacctttatatgttattgatggtgcattttctaataatgggctaaattcgttgaatccttcagatattgaatcaatagaaatcctgaaggatggttcggcggctgccatttatggctctcgcgctgcaaatggggttgtgctgataactaccaagcatggtcaaaaaggtaaagcaaaagttgaaatttctgcaaactattctttgcagactccttctaaatatcttgattttctagatgcaaatgagcatcgcgaatatactaagcaaattgttgaaaattcaacaaaccagactcaagctccagaaaatattcatcctactaatcctgatattaatactgactggcaagatgcatatctaagaaatgctcctatgtataatttgaatgcttcaatttctggtggtggtgaatattcaacttttaatacaagtttggggtattttgatcagcaaggtattatggaattttctggttttaagaaatataatgcacgtgtcaatggaacgtttaagaaaggacgtttgactgttagtgaaactctttctgctgcttttacaaataaggagcctcaagtaaggatggtgatggggattcctactgttccaatgactgatgtagagggaaggtatgtatctgcaggtaaagattattatgtaaatgaaggaaaagttactaatccgtttgcatcttattccaatactgttcgaagaaataaaacagttaatgttactggtagtttgaatataggactgaatttatataaaggattggattataagctactacttggaggtgactatatatcaacaaataatatatctcggtccattgcttttgactccaattgggatgagaatggtaatgcagatcctgattatagcagaacgattaattcactatctgaaagtcgtggacagcgatttagttatacaattgataacattttgacttataagaatatgtttgctggtcatactattgacgcaatggtaggtacaagttggatgagagaatactatagaactatggggattggttctggttctacagatttgggtggtcctaatattactatttttaatgggaaaggagatataacaagtgaagaatacaattcagctttactctccttttttgctcgcttgaactatgactataaggagcgttatcttgtttctgcaagtattcgtagtgataaatcttccaaatttgctaaaggaaatagggtcggttactttccttcggtttcagtgggttggaatatacatgaagagaatttttttaatatagaatggataagtaaaatgaagattagagctagttatggtgaattaggagctaattttatagattcatattctttcctttctacggcttatggtccaataccttctgtattcggtgaaaatcagattggtcaaagtagtgtgatgaatggttatgtaaccaaatttgctcaggaaaatttgacttgggaaaaatcaatatctaaaaacgtagcattggaaatggcttttctgaataataaaatttcttttacagctgaatatttttggaaagataataatgacttacttgctccattacttccattagcatcgtcagggcaaaccattatgactaatgggggggatttgccagtctttaattctgcatctgttgaaaataaaggttttgaatttacggtaggttatcgtaataattggaaggattggagtttggatgttactgccaatatttcggcattaagaaataaagtaaagagtttgggtgagggagtacaacccattaaggcagaggtgatgatgagtggttcttttaatgaccgtcctactattactaaaccgggcttgcctattggtaccttttggggatatgtggtggaaggttttgataatgatggtaattttatttttcaggataataatggtagtgtgaatggtgtattgacaggaaaaccggatgggaagattgatgagaatgataaaacggatattggtaatcctcatccggattttacttatggtttaaatataaatgtaggttataagaattgggatttgactgcttttttccaaggaacgcaaggtaacgatatttttgctttaatgaaatatgattggtattttggaggagctaatagtgctaccctaaaggatgctttctataattcatggactccgcaaaatcctaatgcagaagctcctaaactgaatagtaaaaacagttctggcataaactcgcttccaagtacattctatgtggaggatggttcttatttcagatgcaagaatctacaaatcggttattcctttaataagaaattattgcaaaaattccatatagaatcatttagaatatatgcgggggtacaaaatttattcactatcacaaaatatcccttgtatgatcccgaagttagttcaaacgtgttgtttgacagaggtgtggatggtttctggcaagcacaggaaagtcctcatgaagcaacaatgaattctagagtatataatcttggtgtcaatttaactttctaaaaacagaataagtatgaaaataatgttgcgtaaaattatagttatcattatcagttttgtaactattggaatgatgggctcatgtgaagatatttttaatgatttggcggtgaatcctaatcaatcagacgttaattcattttatactacactagaaaattgtaataagggaattcttggtatctatgggtatatttcgactcctcgtaatttgggagcttgtggatttggtttgatgttgactcgtagtgatgaggggtgttcggtagctgattatggagtaccaggtgcttataatgaagagtttaccccttcttattattcattggttcaaccttttcagttaatgtatacagctgcttcccaagctaaccaaatgattgaaagtcttactgaaatagaattcagcaataaagaattacaggatgcatatttgggggaggcttattttcttcgtgcatttacacatttctttttattcatcaattataggaatattcctttgattaaagaattgcctaaggctcctaatgaatataagcctcaggcaacacctgaagaggcttgggattttattatagatgatctgatcaaagctaaagatttacttcctgacaagaatttttgggatgctaaaaataaaggacgtgtgacgaaagcttctgcttatgcacttttgggtaagtcatatctttatagatccggtattgaacccaaatatggaacttcacaaacaacttattataatgaggctgctgcggcttttgcagaaatcattaatggtaattgtggaaactacagattggtagatgactattcatggaactttgatgtggcacatgaaaataatgatgaatctatttttgaagtacaatttgtcggagtgttgaatacaggatttaacccaggatttgtggacagtgggttgttcaatgatgtccggtgtaaaatgtgtataatgaatagaagtagaaattcgaatagttctgcacaggttatgcacaattggttatatgataaatttgtagcgtcaaaaacagtgacaggagaaactgatccacgtatgtttggttcgtttgtttttaatgataatgtatcggagattatacgtccgaaaggtatgaaggttacttttcttgaagggaaggattgggaagcagaaatgggttcaaaggaaggaacatttggtgaacaatatgagttggcaatgggatataaaatgtgtagtaggaaatggttggattggaccttacctccgacagatgatgctggtgggcatttttttaatggacgtgcacaaggagtaaactggagaatgattcgttattcggatgttttgctgatgtatgctgaagctgtagtaatgggagggaaagccactgcaaacataaccccgttagaagcaataaacaaagtacgcgatagggtaggagtacctcatgtaacagaagctaatatgagaactattgaagatgaacgtattctagaacttacctatgaaggcttccgattctttgacttgcttcgttggggtaaagtagtagagcgttttcgcgaattggaaaatactgatcctttgtttaaaaggtttagcagggctcaatatatggggtttaaggaaaataagaatgaatgggttccattgccaattgatgaagtagagggtaatccatatatcactaaaaataatccaggatggtaattaaaaatagaataattatgaaagtattttattatattatatgtgcagcttgctttgccggctgtgtgtcatcttccaatgataaaacggtgaaagagaatggtagaacattgcataatggcattgtgctgcccgagcaatggcctcctagtatgattgatgatggagtacgttgcgaaatgtctttaccttatatttcaaacaaaccgactgttatttctgtaaatctaggacgccaattattcgttgatgattttttaattgcagaaacagatatggagcgtgtttcccataaggctatgttctatgagaataatccggtacttgctccggataaggagtgggaatacacttttgaacgtgctccttatgctgctcctttcagtgatggaatatggtatgatgaaagcgaacaaaaatttaaaatgtggtatttggctggtgccggatctatgcacaaacatcgtcaaagcttttatacttgttatgcggagtcaaaagatgggaagcattgggaaaaagtgaatatggatatagtgccgggtacgaatattgtagatacttgtgatcgggatgcggctacagtttggctcgataaaatgtgtccagaaccagaaaaacgtttcaaattcttcaatgtggaaaaacatagtggaggatggaaaataattttaaaatattcaaaagatggtattcattggtcggaaggagttgcgcaatcaggaccggtgggggatcgtaccactgctttctataatccgtttactcaaaaatgggctattagtctacggcaggggagtaaagcagacggacgctctagaggctatttggaaaatgaagatccagagatggcagttagcgtggcgcattcattggctaaaggaataaaggataaaaatatagttttgtggtttactccttccgataaggaactgccacatcctgaatttcctgatgtgcgtccagccatttataattttgatgctatgccttatgaaagtgttatgctagggttctatgctatgtggaaaggaccagagaatgatctctgtggtaagttaggtattcagaaaagaaatgaaatagggatgggatatagtcgggatggttttcatttttatcgtcccagttatgaacctgttatgggagtaaatgaaacggaaggggcatggaactggggaaatatgcagtctattattggcgtacctctcattgttggtgattctttgtatttgtattctagtggaagaatgaagaataaagtgatgtgggatggatttacttctactgggttggcaactttacgtcgtgatgggttcgtttccatgcatacagacacagaaggggtacttgttaccgagaaaataaagtttgatggtaatcatttttttgtgaatgcacaagcaaaggatttgcaggtggagataatggatgaaaatggtaatgtgattacgggattttccagagaggattgtaaggaaatgaatgatttgaacagtactaaacaattggtaacttggaaatcaggtaaaaaacttgctgctctttcaggcaagatagttaaagtgaagttttatgttacttgtggagatttatatgctttttggatttctccatgggacacaggagaaagtaggggatatacaggtggtggtggtccgggactcaatccttgtggaatcgatattaaataactgatatgtataaaacatagttgtgttacatcgtgtattttgttggtggctgcttcatgagaatgaagcagtcattttttgtattacagataaattttgcttggttgagctaagtcaatatttaagtatgaggaaaatgtagacataaaaaaaggagcaacgccttgctccaacctttgttaaccttaaatctaatactatgaaaaacacgttgcaaaggtacgtgttttagtgaattttgcaaataaaacaactaaaaaaatatgttttctaacacgttttaatacttttgtcctatttgttaaggatgaggactttttttatttacttgtattttgtcttttttacatataaaaccgtatatttgttgccacttttgcaaaaggataaaaacgaatggtttcagtagataatttgaaagtagagtttggagtaacgcctctgtttgaggatgtgtcatacgttatcaataagagagatcgtattgcgctggtcgggaagaatggggccggtaagtctactatgcttaagatattggcaggaatacaggcgcctacttcaggtagtgtttctgttccgcgtgatgtgacgataggctatctgcctcaagtcatgattctgagtgataaacatactgtgatggaagaggcggagatggcttttgaacatatctttgagttgcaggctagtattgagagaatgaatcaggagttggcggatagaacagattatgattcagaaaactatcgtaaactgattgagaaattcacccatgacaatgaacgctttttgatgatgggaggtaccaattatacagctgagatagaacgtacattgatggggttgggatttagccgggaggattttaaccgtcctacatctgagttcagtggtggatggcgtatgcgtatagagttggccaagttgctgttgcgacggcccgatgtgttgctgttggacgagcctaccaatcatctggatatagaaagcattcaatggttggaaaactttttgaagacaagtgcgggagccgttgtattggtgagccacgaccgtgcatttattaataatgtgaccaatcgtacgattgaaatatcttgcgggcatatctatgattataaagtggcttacgatgagtttgtggtattgcgcaaagaacgtcgtgagcagcaattgcgtgcatacgagaaccagcagaagcaaattcaggatacagaagatttcatagagcgtttccgttataaggctaccaaggctgtacaggtgcagagccgtatcaagcaattggaaaaaatagttcctattgaaattgatgatgaagataattcagccttgcggttgaagtttccgcctgccatgcgttccggcaattatccggtcatttgtgacggggtgaagaaagcatatggcagtcatatcgtttttcacgatgtgactttgactattaatcgaggtgagaaggtagcttttgtcggaaagaatggggaaggtaagtccactttggtgaaatgtataatggacgaaatcccatacgaaggtaaactgaccatcgggcacaacgtacagattggttattttgctcagaatcaggctcagatgttggatgaaaatctgagtgtctttgatacgattgattatgtggcaaaaggggatattcgtttgaagattcgtgatattctgggagcattcatgtttggaggtgaggcttctgataaaaaagtaaaggtactgtcgggtggggagcggagtcgtcttgccatgataaaacttttgttagaaccggtgaatttccttattttggacgaacctaccaatcatctggatatgcgttcaaaggatgtattgaaagaagctatcaaggaatttgatggaacggtgattgttgtttctcatgaccgtgagttcttggatggactggtgaccaaagtttatgaattcggaggtggagtagtaaaagaacacattggcggcatttatgattttttacagaaaaagaaaatagagagtctgaatgagttgcagctttcggcttctcctactatgtctgccactaaaaaggaagaactcgaaacggttagtgagaacaaattatcttatgaggcgcaaaaggaattgaataagaaaattcgcaaattggagaaacgaattgcggattgtgaacagaaaatagaaaagctggaaactgagattggcgaggtggaagctgatatggctactcccgaaggtgcatcggatatggctttgtatgaaaagcatcagaaactgaaaaaggacttggatcagacggtagaagaatgggaaaccgtttctatggaattagaagagatgcagggaagttaaagtatgtatcatatatatagaacaaatgaaagcaaaacattatttaccaatggctgtattggctctggcagtagctgccggatgtgacagtaaaaaggaagccgtcatgacttcgggtatagacttgacaaatttggacactacggctgttcaaggagctgatttttatcagtatgcttgtggcggatggatgaagaaacaccctctgaccaatgaatattcccgttttggctcattcgatatgcttgctgaaaataatcgggaacaactgaaaggattgattgtggaaattgctgccgggcagaatgcgcaaggtacaataggtcagaaaataggggatatctataaattggctatggatagtgtgaaactgaatgcggatggagtaactcctattcaagctgatttggaaaagattgcttcagtgaaggataaatcggaaatagttcctttgatggcggaactggctcatagcggtgtattcccttatttcagtttctatgtgggtgccgatatcatggacagcaagagcaatttgtttcaattgtatcaagggggtatcagtctgggtgaaaaagaatattatctggacaatgatgatgtgactgtcaatatccgtaataagtataaggaacatattgtaaagatgttccaattggctggttttgatgaggctgccgctaaaaagaaaatggaggctgtaatggatatcgaaacccgtattgcaaaagcttctttcagtgcggtggaacagcgtaaccctgcggccaattatcataaaatgtctttggatgaattaaagaaagagattccgggcattgactgggatgctttcttgaatggtataggcgtgaaaggggtgactgaactgagtgtttctcaagtggatccgattaaagaggttgagaaaattatcaatagcttgccggttgaaaatcagatcgcttatatgcaatggagtctgatagacagggctgccggttacttgagtgatgatttggtggcacaaaattttgatttttatggaaaaacactatccggaaaacagactaaccaacctcgttggaagcgtgctgtaagtactgtaaatggagtactgggtgaagcggtaggtcagatgtatgtggagaaatattttccggcagccgcaaaagaacgtatggtgcagttggtaaagaatctgcagaccgcattgggagaacgtattcggaatttggaatggatgggtgacagcacaaagattaaagctattgagaagttgaattctttttatgtaaaggttggctatcctgataagtggagggattataccggtttgaatattgaaaaagattcttattgggccaatgtgaagcgtgctacagaattcgaactggattatatgttatccaaggcaggaaagccggttgacagagatgaatggggaatgactccgcagactgtcaatgcatattataatccgaccacgaatgagatttgttttccggcgggtattcttcaatatccgttttttgatatgaatgctgatgatgcatttaattatggagctattggcgtggttatcggtcatgaaatgactcatggattcgatgatcagggacgtcagtttgataaggatggtaatttgaaagattggtggacagccgaagatgccaaacgttttgaagaacgtgctcaggtaatggtgaatttctttgatagcatccaggttttgccgggactcaatgccaacggttctttgactttaggtgagaatatagccgatcatggtggtttgcaggtttctttccaggcgttcaagaatgcgacaaaagatgctcccctgctggtaaaagacggatttactccggaacagcgcttcttcttgtcatacgccggagtgtgggctggcaatatccgcgacgagcagattcgtttgcaaaccaagtctgatccacattcattgggcagatggcgtgtgaacggagcactccctcaaataggtgcatggtatgatgcttttggcattaaagagggggatcctatgtatttggctcctgaaaaacgtgtttctatttggtaagctttgtatgtaaaagataataagaaagcatggtaattgctgagaattcggcatttaccatgctttctttttggaatttacatgataaacacctatttttgtgcccgatgaaacggagacgatacatagcatgggtattgatgttggtcagcattatcatgttgacagcatctgttctgcctcatcatcatcaccgggaaattctttgtttgcagcatgatatgactttgtgcggctgtcaatgttccgtgcagcatcagcagcataataatagttctgatgagaatcatacatgtaatgccggatgtgtgaccaagtttaaaagtgtaactccggatcgggcccaagacagtgtttctcctgattattcgttttgtttgctgttatatacggtgacggatgtattggcgctttcattgcggttgacagaacacaacacattaccttataattactatttagaaaaactgcattctacgtgtcttccccacgtaaaggggttgcgtgctcctccttgcgatgttcttgcttaacagatagaaagtttatctttttatccgcaactttgttgcattttctttacactaattttgcatttagtaaaaagtaagaacaaataatatcatcatgaagaaacttatctttatgggagtcttaggcttgttcctcttaggctcttgcaacagtaaatcgggtcatgatcacgaaggacacgatcatggaacggaggaagcacataatcacgaccacgaagggcatgaccataatcacgaagggcatgaccatgaaaaagaaaaccacgaccatgagaatgaaggtcacgaagggcataatcatgaagcggaagcttctgcagccggacattccgatgagataattctggctccagaaaaagcaaaagcagccggggtagaatcggaaataatccggcctgaatcattccgtcaggtgataacgaccagcggtcaggtgcaggcagcacaaggcgatgaaagcgtagtagtcgccaatgtagccggtgtggtttctttccgccatccggtaacggacggtatgagtgtgagcaagggggctcccattctgaatatctctgctgagaatatgccggacggagaccctgtaaaacgtacccgtatcgcatatgaaaccgccaaaaaagaatatgaacgtgccgccaagttggtaaaaagtcagataatatcgcagaaagatttcaatgccattaaggagagttatgaaaatgcattattggcatacgaggctatttcaaagaaccagaccaagacaggtgtgtccgtcacagctcctttaggtggttatatcaagaattgtctggtgcaggaaggtgactatgtgtcggtaggccagcctttggtgagtatcactcagaaccgtcgtctgttccttcgtgcagatgtttccgagaaatattatggttatctgcatagcatccagtcggcaaacttcaagactccatacgataataaggtatatgagctgggtgagttgaaagggcgtctgctttcttatggtaaagcatccggtggtacttctttttatgtgcctgtaactttcgaatttgataatcggggagatgtgattcccggttcgtatgtggaggtgtatctgctctcgtcggaaatgcccgatgtgctggccttgcctgttacggcactgaccgaagaacaaggtttgtactttgtttatctgcaactggatgaggaaggatataagaaacaggaggtaactttgggagcgagcaacggaaagaaagtgcagattctgaccggtttgaaagccggtgaccgtgtggtaacaaagggagcttatcaggtgaaattagcgtcggctagcaatgcgattccggctcatagtcatgaacattaatcagccgtcctatgctaaataagattatacatttttcccttcagaaccgtatattggttctggtggcgtcggttttgctgcttatcggcggtacttacacggcttttcatacggaagtcgatgtgttccccgatttgaatgcgccgactgtagtgattatgaccgaagcgaatggtatggccgccgaagaggtggaacaattggtaacctttcctgtagaaactgccgtgaacggtgcgacccatgtgcgccgggtgcgttcatcttccaccaatggcttttccgttgtgtgggtggaatttgaatgggataccgatatctatctggcccgtcagattgtcagtgagaaattgtccttggtcagcgaggagctgcccgagaatgtaggtaaacctaccatgggacctcagtcttctattttaggtgagttgctgattatcggtctgacttcggatactacttccatgctcgatctccgtacactggcagactggactatccgtccgcgcctgctctctacgggaggtgtggcacaggttgccgtgctgggaggtgatatcaaggaatatcaggtgttgcttgaccctgcccgcatgaaacattacaatgttacgttggcagaggtgatgaacgttacccgtaacatgaatcagaatgccaatggcggagtgatttatgaatatggaaacgaatatattgttcgcggggtgctttccagtcatgatgtggatcagttgtcacgttccgtcatcaagacggtggaaggggtgcccgttacattggaggatattgccgatgtgaagattggttcgcaggaacccaaactgggtactgcttcggagagaggaaaacctgccgtactgctgaccgttaccaaacaacccaagaccgggactattgaactgacagagcagttggaagccgcattgaaggatttgcagaagaatcttccggctgatgtacacgtttctacagatattttccgtcagagccgttttattgaaagctctatcggtaatgtgaaggattcgttgtatgaaggtgctgtttttgtggtgattgttctcttcctgttccttgccaatgtacgtaccacggttatttcattggtaacccttccgttgtcattgattgtttctatattgactcttcactatatgggactcaccatcaataccatgagtttgggtggtatggccattgccattggttcgttggtggatgatgccattgtggatgtggaaaatgtatggaagcacttgcgtgagaatcgcttgttgcccgaaggggaacgtaagagcgtgattgaagtcgtgttcaatgcttcgaaggaagtgcgtatgcctatcttgaactctaccttgattattgtagtcagctttgttcctttgtttttcctgacaggaatggaagggcgtatgctggttccgttgggcattgcctttattgtggcgttgtttgcttctacggtagtggctttgacactgactccggtactgtgcagctatctgttaggtaataataaaagcaaaggattgcccaaagaggcatttgtggccgtatggatgaaaaagcattaccgcaatgccttgttatggtccttgaatcataaatccgcagtattgggttttacgggtggactgtttgcggtggcattggttatgttttttacattaggacgcagtttcctgccatctttcaatgaaggttcgttcaccattaatatcagttcattgccgggaatttctttggcagaatcggataaaatgggacaccgtgcagaagagttgctgatgtctattcccgaaatacagactgtagcccgtaaaacgggacgtgccgaactggatgagcatgcattaggggttaacgtgagtgaaattgaggccccgtttgaattgaaagaccgttcccgccaggaactggtagccgatgtgcgtgccaagttatctaccattaccggtgcgaatatcgaaataggccaacctatcagccaccgtatcgatgccatgctttcgggtaccaaggccaacattgccatcaaactgtttggtaatgatttgaacaagatgtttgccatcggtaatcagataaaggatgccatcagcagtgtggagggtattgccgacttgaatgtggaacaacaaatcgaacgtccgcagctcaagattgttcccaaacgcgagatgcttgccaaattcggtatttctttaccggagtttgccgagtttgtatcagtgaacatggcgggtgaagttgtttcacaggtatatgaagaaggcaaagcgtttaatcttattgtccgtaccaaggatgaggtgcgtgatgagatggagaaggtgcgcaacctgatgattgataccggtgacggtcagaaaatccctgtcaactatgtagccgatgtggtttctgccatgggaccgaataccatcagccgtgagaacgtgaagcgtaagattgtgatttcggccaataccagcggtcgtgatttgtgcagcgtggtgaatgatatacaggaacggattgatgcgcaaatcaagcttcccgaaggatatcatgtggaatatggcggtcagtttgaaagcgagcaggcggccagccgtacgctgatgctcacttcgtttatgagtatcgtggttatcttcctgttgctttatacccagtttaagaatgcagcccaaagtggagtcattttgttgaatttgcctttggcgttgattggtggggtatttgcattgatgataacaacgggtgagataagcattccggctattatcggctttatctcgttgtttggcattgctacccgtaatggtatgttgttgataagtcattacaatatgttgcgcgaagaaggtatggatttgaaagaaagcattcttcacggttcgttagaccgtttgaaccctatcctgatgactgcgttgtcttccgcgctggctttgatacctttggcattccgtggcgatttgccgggtaatgaaatacaaagcccgatggcgaaagttattcttggaggtcttttgacatcgactttcctgaacgctttcattattccgattgtttatgaactgatgaaccgaaagaagaaataatagaaataatatgaaacgaatcttagttataatagccctctgctctcccttgctgatgcaggcccagagtattgagcacattttgaaaagcatcgagcagaacaataaagagctcaaggcacagaaacatgccgccgatgcgaccaagatggaaaaccggacaaacaacaacttgcctgatcctacggtgagctacagctctttttacagtaatggtgccgaaggtggtcacggtacggaattcgttgcttcgcaaggttttgattttcctactcagtatattgcccgcaaccggcaggctactttgcagaacgaagcggtggacaagcaacaacaggctgcccgccgggatattctgctgaatgcgaagaatctctgtctggaccttattctgttgaatcaggaaaagacattgatggatatccgtatgaaaaatgcggatgaattacaggcactttacgagaaacgtctgactgccggtgatgcgaatatactggaagtcaacaaaatcaagatggagcgtatgaacgtgcagacggaagttgcccaaaacagcgcagcccaccgcactgccttgcaatctctgcttgccatgaacggcaacatgcctttggagtttgctgaaaccacataccctgccatacaggaaatcaatgattacaatgtcatgcgggatgaagtgatggcatcagaccttgacttgcaggccgccgtcgccactgcccgtgccgccgagaagcaggtttcggtagaccgtcaaggatggttgccgaaactggaagccggttttcgccgtaacacggatgatgcggtttcgatgaatggttttgtggtagggggctccttgcctttgtttcagaatcgtaaaaaggtaaagatagccaaggcacaggctatcagcgcacaattgatgcaagaaaatgctaaagatcaggttgaagcttctctgatgtctctcttcaatgagatgcagcagttgaaggatgccatgaatgcgtatgatgtccctttgatgtaccgttcgctggatttattgaagcaggcattgaccgaaggacaaatttcattgattgaatattttgtggaaacggaaagtatttataagaatcttcaggcgtatatgcagattgagaatcaataccagaaggtgatggcgaatatctataagaacaacctgtaggatgttaatatccgctgagatatagtagtgtaggggggatgttatagttgacatcgcccctaaaacttatcttgtcggttcagtaagtaaaatataaaaaatgaataggaaatgaatttagaagaggtattgaacttccgccggtctgtgcggaggtatgataaaaataaaccgatagacccggaaaaggtgaaacattgtcttgaactggctacgctggctcccaatagttccaatatgcaattgtgggaattttatcaaataacgaatcccggactgatggcgaaagtttcagaagcttgtttagggcagtcggctgcttctacggcttcggaaattgttgtttttgttactcgtcaggatttgtataaaaagcgtgctaaatttgtgcttgactttgaagaaggaaatatcaggcgcaatagtccgaaagagcgtcaggaaaaacgtattagggacaggaagctgtattatggtaaactgatgcctttcatttatgcaaggttcttcgggcttctagggcttttcagggtgatattggcgagaaccatcagcctgttccgccctatgatgctggaagtttcggaatgcgatatgcgtgtgacggtaaataaatcctgtgcccttgctgcccaaacctttatgattgccatggcaaacgaaggctatgacacttgtccgctggaaggttttgacagcaggcggatgaagaaactattgaagctgccccatggggcaggcatcaatatggttataccttgcggcatacgggatgggaacaaaggcatttggggagaacggggcagggttcctttcgatgaaatctatcataggatataagagaacagggtattcctagcgggtgatgaaggtgtattcccttagatattccatcagcatgccgaatcgctcttcctgagtgtgcttggaagaagacgtcttgaaaccgtatgtggggtctgcgtgttccagttccttttcaccctttctgtatacttctttgacaaaatggcgtgtcggattgaatttgacactgtcgaagtgctttggccggaaattataagaatgccggttatgccctttttttgattctcgataaaatccggaaacggttgttgttcggacggcataaaaaaatgtgcctgaagaattgggctgccttttatgacagagtgacttccggcacattttttcttgtttatttctatttatttcttttttttcttggcttctttcgcccattctttcgctccctgctctttcagtttcgcggtgaaagcctttgctttttccatgcttgcgttttcgtcttcgggtgaagcgtatgcatgtttgtaacctttggtcacgttccattcacctcgtgtgaagtccgggaaggctactgccgcacagccgttatccatagagatagctcccagttcggccaaacagcaccattcggccaggtcatatacatccatgtccaaaggcagtccgttttgcaggcaatataccagacggctgtccatgatgaagtccataccgccatggccgccgacttcttttgccatttcaccatatttctttaaaataggatgctggtatttctcaacaagtgcttccatttctgcctggggtaagaatccgtgagagttcaaatcgtctactttgggttgcacacccgatgcggtcagttgtgctgcatccaaagcatatccttcaacgggatatttattggcaaaccctttgcttcctgtcagttggtacaggcggttgtaaggttggggagtcattacattatgttggatttcaataacttttccatttgctgtgcgaagtagggtggtggtatggtctccgttacggaattctttacattcttcgccggttctcttctccactaaatctttaccaacaacagatttggtgtccatagctactaaagtggttatacggtcaccacgatggatatccaatgcttgtgctacaggacccaggccgtgagtggcatatacatcaccccggtgtttcatgttataatccaaacgccatcccagtttgtcttctttgccgtttttccaataatgatcccaaaacgggcttaaattgtgaatgtaggctccttgggcacggattacttcgccaaatacaccttgttgtgccatattcagtgtattcatttcaaaccagtcatagcaacagttctcaagaatcatgcaatgcttgcggtttttttcactcaggttgattaagtcccagcattcttgtaggttcatggccgagggaacttcaatagctacatttttaccgttttccaatgcgcattttgctaccgggaaatgatgcaaccagtctgcggcgatataaactaaatctatgtctgtacgtttacataattcttcatatcccttttctccggaataaatggcagctttcggcatagatgctttctttaggatatcctgacatttttctgcacgggatgcttcataatcacaaagggccacaatttgtgtaccgggaatataagtgaagcgctctacggctccggggcctcgcattcccaatccgacaaatcctacgcggactacctccattttaggggtggttaagcctaatacgcttttctggccggccggacgttcaggagtatcaatcacaatggttcctttgtcccatgtccaggaatctcctgaacttacggtttgtgctgtcgtggtttgtggtaaacacatgcatagggttgtacccatacataagcttatcatcaatgatttaaaggttctcatactttttgaatttaaagattaaaattaataataagagttatttgtatttcaagggagtatagcaatcgacatgcttttctggttcattagaaaaggctgccttctgttttacgttctccattgtatctatttaattttaatgggcatttccgtgataaagaaataccatttttatatagtttcatcctctaacgttgcttgggtaaagcacaaaagagcgttctatttgttcttacattagaaataagaatctttttatttcgtggtcaaagatagtcattccttttaaattacatgcatgaatttcctatctttcttatgtgtaattgcaaaataaaataaggcttgtcaataagtagtaggaaggcagagggttaaaaaaagggcctgatgtattaacatctgggttgttgccgatttcttacataaaataggatggctttggaaagtttggatgatatttagtgaacaatgttttaatacaaatagcagattatttgatcaattattttatatgagaatgaattgatttacagttgtttgtcttcttttactgaatttgagtaaaagaaatacctaaattagtaaggaactttattgacttgttcttatgtttgtggtgttaattttaatttaagataatgtaaattatgaaaaatgccaaaacgttaattaaaagtcaatgcaggaatacgcatcaagccttgatgtgctttctttgcttctttttcttttttgcaggaatgcatcaagtggtacatgctgttccagatgttgcaatgaagatagatcaggatgtgcacattactggtatcgtacaagataccaataaagagcctatgattggagtatcggtaatggtgaaaggtactacgaatggaacggtcaccgatattgatggaaactatagcttgtcggtgcagggatctaaaagtgtattagtattctcatttgtaggatatgtaaccaaggaagtgactgttggaagtcagaaaacgatcaatgtaactttggctgaggattctaaaatgatagatgaagtagtggtgattggtttccagtcacagaaaaaagggaatttgaccgctgcagtagcttctgtcagtgcagagacactggaagacagaccggttgctaatataggacaagctttgcaaggcatggttcctggcttgaacatcagtattgaaggcggtgaccctaacaaagttccgaatttaaatattcgtggtgccacgacattccgtcagagaggttcatccaatgacgataaaaacaaatttgatgtagtttccggttctccgctgatcttgatggatggtgtggaaattactgctgaagacttgaaccagttaaacccgaatgatatagataatatgtcgtttctgaaagatgcttccgcttcggctatttatggtaccagagctactttcggtgtgatattggttaccaccaaatcgggaacctacaagcagaaagcgaaaatagattattcttataatctggctttcgaccagccatacgaattgcccgatattttggattcttatcatatttacaaagctggtgcggataaaagattgtggaccggtgaaatcactgaatacacccagcatgacaaggatatgatggaaaatatgatggcatatatcaaagatcccgtaaataataaaccttattatatggaaggtagtgccatccagtgggtaggcaatacgaatccatataaagaattagtgaaaaactggactcctacccaaaagcacaatctttctatcagtggtggcggtgacaaaatcagttattacatttctttgggtatgcaagaccagaaaggtatgtataaaatcagaaccgatgaattgaaaagatacaataccatgcttagtgtgaacgctaaagtgaatgattggttcacggtggcagccaaggcttcctataatgtatttgattatgagggaccgacccaacagacagatggaatgaatctttggcaatatgccaaaacctattatccggaaaactttatttatcagccggtgctgacaggagcagacgatccgttacccaactatgtgacagaaaatccggtgagttatttatatgcaggtggtcgtagtgttacttccagaaggaaaacaattctttctatcagtccggaatttactatcttgcccaagatattgaagataaaggctgacttgtctttcactccgactagttatcagaaagaaaagactcatcctaaacaagcgcgtgttaataattcatggactgctcttgaaactcgttgggctaccgaaaatagcggagaggtggtacgcactactacagacaggtatgccatcaacgtatatgctgattataaccagaccttcaaagaaaagcataatgtttctgtgcttctgggtgtcaatcaggaacaagaaacttatgccggttctaccctttatttgaccaaaatgcttgatccatacattctgaatcctgaattggtggaagacgtaacggcaaacacttcaagcaattatcatcatgaggtagcgtcaagggcgttgtttggccgtatcatgtataattatatgagcaaatatctgatagaagtggatgcccgttacgatggtagttccaagtttcccaaaaactctcgtttccaattctttcctactgtttcattaggatggagagtttcggaagagaaatttatggactggacaagaagttggctggacaatttcaaaatcagagcatcgtggggacgtttgggtagccagcctgatacggaatatccttatcagtctgttttcggaaccgagcagggatacttcttgtttgacggaacacgttatcccaccggtatcgttactccttcattgatcaatcctgaattgacttgggaaaaatcaacgaccaagaaccttggttttgatttcactttcttgcagaaccggttgacgttctgtgccgatattttcgaaagaaaggtgactgacattttgattccgggaggaaaagattatccggctttgattggtgatgataatctaccttttgaaaatgcgggagtgctgaaaactaccggctttgaacttcaggcaaaatggtcagataaactgtcaaacggatttgcttatagtgtgggtgttgccctttcggatgacaaggctgaagttttaagttatccttccaatcctaccaataagattggtgacggtgtattgtacaagggatataccgtaggagatatttggggatatgaaaccggaggtatccttcaggaaagtgattttgacggggtaggtcccaacggaaaacctttgtaccatggagcctatttcaagggtggacagccctatccaggatacgtttggtatcaagatctggatcatgatggtgtgattaccagtggcttgagtacggtggatgatccaggagacaaaaaggtaataggtaataatgcaccgcgttatcgttataacattaccgccaacttccagtacaaaggatttgacctggatttgatgttccaaggtgtaggtaaaagagattattggttgaaggatgtttccagttactggggtggaggagccggttcatgggaaacatacaatcagtcatggacgcccgaaagaacagatgccaaattccccatgtatggttccggaatcggcagctatgctcaatcaggctatttgcttgatgcttcctatatcaaattgaaacaggtgatcttggggtacactttcccgaaagcattgattggcaaagtaggtttggagaagttaagactgaatatagccgcttataacttgtttactctttcggatgtgcccaagtattatgattcggactatctgtctgacgcatatccccctaaacggacgtttagtgtaggaattcaagtaggtttttaacgttttaaatcaatagaagttatgaaaaaatattcaattatagctttattcgtggctctggtagtatctctgtcgtcttgtaacgatgactttatgcagcggaacccgatagatgatatggccgatggtacgttctttacgaaagaagccgatttgcagctatatctggacggaatttatagatattatgtatatggtcacggtcacggtggaactaacagtaccacacatgataaaggtttcttggcagtgaaggcaggcagccaaataatctttggagatgcttttagtgacaatactgtttatgcaggcgatattgatggtaagttgggaggtacttatgacactccgaattcggcttccaagaattttgacacaccctggcagtgggaaaaacttcgtaaagtaaactattttctgaatcattacacagaagtaggagatcctgaatcattgaaaaaatatgctgcccaagcttatttcttcaaagcatgggattactatatcaagctggtggctttgggcgaagtgccttggctggataaagaactggatacggcttctcccgagttatacggtccacgtatgccccgtacggaactggtagaaaatatcttgaaatgttttgattttgctgttgaaaatctggaagataatgataattcttgcggatacatcaatcaggatatggctttgttcctgaaatctcgcttctgtctgttcgaaggcactttccggaaatatcatacagaattgaatttgggctctactgccagtaaattcttggaaatgagtcgtgatgcagcaaggctgattatgaataaggacagatatcatcttttcaaaaatgcgtcgggagatgcctactggcagttgttcgtacagaagggaacacctgaactggagggtaatgaggaaacgattcttgcacgtgtatatgacggtgtgaagttaggacatgataacccgcgttattggggaatgaataatcatacacgttactgtatgggagctcctgtatgtatgcttgaagaatatttgtgtgaagacggacgccctatttacattggaggcagtgaaggtaattatgaagtaaaccctttgttcaaaggatatgacggtatgtgggaggaactggacaatcgcgatcctcgtttgaaacaaacagtttgtaaaccaggtgaatatgcttctatttttgatatggacgacaatacctatggtttggaagaaaccggggtgatctatccaatgattacttatgctaccggtggtggatctccgatgaagcactataattctacagtgaccggttatcgttttatcaagcactggatgcccgattatgcaaactgggaagctaatcccaaaggggtgcagacagcccacatgttccgttacggggaattgttgctgatttatgcggaagctagggctgagttgggagaaatcaccaatgaagatttggatattacgatcaatgcattaagagaaagagccggatacgactttgccaaatatcccaatgcccgactgactttgtccaacattccggctgatccacgtctggatgctatctatgcgcaaaaactggattattccgtatctcctattcttcgtgaaataagacgcgaacgtcgtgtggaaacgatgatggaaggcatgcgttatgaggatttgatgagatggaaagctggtaaattattcacagtttcagtgagaggaatgaaaatgacacctgaaaagattgaattgtacagtaagaaccgtaatgatgaaacgtataaggattatccatacaaggtgacggttcctataggagaagtaggtaatcaggtgattgtggatgcagaaggattcattattccttggtctacctctaccactgttatcaacggcgtgcgtccttgggatgacaaacgttactattatccgatacctctgaatgaaatgctgatgaatccggaactgaagcagaatccgggttggaaagacattaatagataacctataaatataacgcaagattatgaaaaaaaatatatatttcttagtaggaatgttttcattcggagcactgtgtacggggtgcagcgatgatgacaacacaggcaaagcggtaaatattaccgtgaataatgctacgaatattgaaagcgatatcttcgggattgatgtgacggaaggacagcctctgcaactaaaaccgttcatcatgcctgagagtgcaagagaaaacgctgtcagttaccactttgcaggagaacccactggagcgattgaattgagtgaaagcggtttgattactcctaaattaactacacctgccgaaggggatatcccgtttccattgggtacggatacgattatcgtcagggtggacgacggttcgggtacatacgtcagatatccggtccgggttattagtaatgtagttattgtttcaagtatcacgattcagtccgctggacaaagtgtggaagtggagaatggtaagacattcaatctggctcaatatgtagcaatcaatccgagtaatgccaccgacaagagcgtgacctattcgtcgcaggacgaaacagtggctacagttgacccgaacggagtaataacggtaataggagaggttggacaggctacaactattacggtaaccgcaaatgatagaggcaaaatgtcagccacttgtagagtgaaagtagcggctgaagctcccatatatgtaggttttcctttctctgataattggaaatactcaagtaatataggtacgaaagaaggggacatgaagaatctgtttgatgataagaattcaactttttggtgtcccgatatcttaactcgtcccatttatgatccggtatgttatctggatattgacttgggggaagtgatcaagttcggtcaattgggatacaggcatcgtagtttgaattattcccatctgcaatgccatagctttaaactagaggcaaagaaagaggcgggtgatgcttggagcgacttgggagtacaagtcacagcacctttgaaggtagatgattaccaattgttctctgttgaaccgatagaggccagatatatccgcataacctttatcaaaggtcatttaagagaaggtcagactgattggaattattcagaagcaggaaatgtttctgttggagatttgcaagtattcatttataacagataaatgatttaaaacatagaaggggaatctttgcaaagattccccttctatgttttattttttacaatgctatcttttccttacttttgtatttattatcaatttcaacttttaactcaataagccaacatgaaaagcagatacttattattctttcttatccttatatacataatttccccatgcaccgctaccggagactataaattccggacaatgtcgcctagcggtggcttttattatgatggcataaaggctatagagcaggacaaggaaggttttatctggacgatgatggattatgaactttatcgcttcgatgggtatcattacaaaaaatattatccctattttgcctcgatggcgcctacaaaaaggtggatattcaataatatggcatccgatttattagggtatctttatgtcaatacgaacaatggcgtttatcgttatgaccggaattcggatcagtttgaaaaaatctatgatccggtaagccatatcaaggtagataaggcaaacaatgtatggatccggatcaaagaaaaatggagtattctgaatacacagaccggagaattgaatactcccaattatgatgggaaagcagcgggtggcgtcaataccgccttttgtatttataataatgatctgtatacatttataggacaaaaagtatatcgtttcaattacgcaaagaatgaatttgtcttttgtctcacattgcccgactcggatggaaatattcgttttgcacaggcatacatggggaagttatggatattcgtcaacaattctggattatataaaatagatatgtctacctttaaaatagaagaccattatacattgcttactgactatgaaggaaattcattgcggacattctatattgacaaaaaaggttatatctggtttggaacaattgatggcatttatatattcgatcctacagacggtaagttgtcacacaataaacattccagaacagatccattcagtttgccgaataattccatttgggaaatcagtgaggaccggcagggtaatatatggattggtacgtattcgggaactttatgctatgtgaatattgatgaaaacaatgccttcaagacataccatcctcaaaatagcggattgaatcataccccggtcagtgcgtttgccgaagatcaacagtatctgtgggtaggtacggaagggggtggtataaaccggatgaataaagccacgggagaattcagctatattacaagtgcaaacagcatcacttccaacaatataaagtcattgattacggatgctggtcataatttatggatctctacatttatggggggattggatttgtataatgtcggtcggcagaaggtgactaatttcaagcataccaaaggtgctcctcattccttgctggtgaatgatgtgcggaagacgattcttgaaggggactcaggaatgtgggtcgcttatcaatatcaaaaggcggaagtgtcttatttttcgtttcgcgaagaatcgttcacccatttcagtttggacagtataagtaataattcttatttgtttgatattcttcgtcaaggggaaaaaacattgtgggccattagtaacgaaaccctttatcgcttggacatagataagcatgtcgtcgagaaaatgattcctaatgattctacctatttgggattgtttactttctgtctggatgattccggaaatatttggattggtaccattggtaacggactcattaaatttgataccaatacttcccgttttatatctttgaaagatgtattgcaacaaagtgtttattccatttatagtatctgttatgatgacgggaacatttggatgggaaccgatgatgggctatattgttataatattgtaggtaaccgattgatgaattttgataaaagagaagatacacaagggcaagtttattatcctttggcctgtatgaaaggaatggacggcttgatttattttggcgggacaaatggttttaccgttattgaccccaaaaagatttcttataacagttataagcccagagcgattatttctgattttttcatcgatcatacatccactcatccccattatttgtttgataattcacttcatgaaataatccttgagtatgatcagactaactttggtttccaattttcttcagacaattaccatattcctgaaaagaaccggtttaaatataggttgagaaagtatgatgatcattggattactacgaatgcacagaatcgtattgccatgtattcaaaagtaccagccggaacttattatttcgaagtttatgctgccaataatgatggtgtgtggagtgatacccctacagtgattaaagtaatcagaaaaactgccccttggtatagttggccagcatatatcctctatgccttaatgattataggtctgatttacttgatttgcagacattatgctgacaagaaaaaactaaagttacaactctacttggagaatatagaaaaagataaaaaggaacagatccatcaggcacaactgcgcttttttactaatatttcgcatgatttcaggactccgctttctcttatcatagccgctttagacaaattgcgacgggaaggtttgaaagaatattattatcggatattgaatggcaatgcacagcgtctcttgaacttggtgaacgaactgatggatttcagaacggtagaaaacggcatgatgaaactggaattgcaaccattggatataaatcatatagtcaaagaaatagcgaatgattttatagactatgctgaacaacgcaagattgattttcaggtgatttgcgatactgaattacctgtgacgatttatgcggatagaaatattgttgagaaaatagtgatgaatctgttgaataatgcatttaaatatacgcccgacaatggaaaaatattgctggaaacaagaggtcgaaaagattgttttacttcagaatataagaacaattttatagtgggcgaatgtgttgatgatacttttttcatccttgtcagtgataccggagtcggtgtctctcatgattccattagtagcgttttcgacagattttataaggtgaatactgtaaatacagattcgcatttgggaacgggaattggattggcccttgttaaaagtttggtattgctccataaaggcagtatctctatttttagtgaaagaggacggggtactgatatggttgtccgtctgcctcttgatagtggtatgtttaatgaatccgattttataaggcatcaagaaacgagagctgaagaaataatccggacagactcggaagaaatggcaacttctgttgaaatgaaagggatggaagatgaattgctgcattcaactaaaaagaaaatattgattattgaggataatgaagacttgagaatgttgattgccgaatcattgtcggatgaatttcaggtaatgcaggctggtgatggagtggaggccttaaaactgatagaacacaccgattttgatttaataatcagtgatattatgatgcctaataaagatggcatttctttatgtaatgatataaaaggagatatgaatacttcacacatacccgttatattgttgacagcgaaaacaagtctggaaagtaagattgaaggagtggattccggtgctgatctgtattttgaaaagcctgttgatttgacttatctgaaattatccattcagaatatatttagaaaccggcggcaactgaaagagcattatgccaaaaattattatgctgacagctgtgaattatcttccaatgaacaggataataagtttctaaaacaatttattgcttttattgaggcgaacatggatcagtccgagatggatatcaatcagattgcgggagaactatccatgagtagaagtaaactttacactaaggtgaaaagtctgacgggaaaatctgtagtggagtttgttttgaattgtcgtcttcgtaaggcggccaagctgattattgaggaaaacatgaccatgagggaagttatgatgcatatcggtatagagagtcaggcttattttactaattcatttaaaaaggtatttggcgaaacacccacagcttttgcagcaaagcataaaaaaacgacccgttaaatgaatcggataaaataaatagcgattagagtaagctatcagaaaggcgaaatagctattttcgcataaactttaaaaaaaataatataatgaaagcacgcttatccattctgatagttactctattactgatactgcccagccgtgtgtcaggaatcggacctgatacaattttttccgacctacagaaaatcatggaacgagtagcggattggcagatcaataattttacttatcaaaagacaggcaatctgcatgattatggtattgatgcatggaccaatgcagtactttatgcaggtatgttgaagtgggttcaaacaacagaagtaccttctacttatcttgattggttaatgaaaataggagaagagaatgagtggtccgttcctgcaaactttgctgactacccgaaatatcaatattaccatgcagatgaattatgcataggacagttttatctgggtatgtacgatcgttataaaaaagatgcgatgcttcatgctgtgcaagaaagagtagactggattatgaaccatccggcagataccagcatgagatattccaataaacagtgctggacttggtgtgatgcactgttcatggctccccctgtctatgttcatctggcccgaatcacaggaaagaccagctatctcgagtttatgcatactcattttttgcaaacttatcatcatttgtatgactggactaaccatttgttctttcgtgacgacagttattttggtaaacaagaagcgaatggcacaaaagtcttttggggcagaggaaatggatgggttttggcaggaattgccaatatactcgaattattacccaaagactcgggtctgcgacctttttatgtgcaattgtttgtagagttggctgctcaattaagtaagttacaggatgatcaaggattttggcatgccagtttgcttgatccggatagttacccgtcacccgaaaccagttccactgccttgataacctatgggttggcctatgggctgaatcatcatttgctggatacatcttatctgcctgttgtccggaaagcatggaaagcactgacttctactgttgatcaaaatggaaaggtcgggtgggttcaacctatcggagccgatcctaaaaaagtaacgcgtgaaatgacagccgtatatggggtgggagccttccttatggcgggaaccgaaataataaaattgatcgaataatcattatcagtcatatattatgaaaaacaaaaagtatctttttttcatttcgctagtttttctctgtgccttctctattcgttttgtccaggctagagatataacttcttttaatgaaggttggagttttaagaaaggacctttttctaaagatcctctgttgttctctgccggttttgatgcccggtggcaggatgtcaccattcctcatacgtggaatgctacggatatgcagaccgaaatgaataattattatgccggtgaggcatattataaaaaacaatataccccggcagcagaactgaaaggtaaaagggtattcttacgttttcaaggtgtaggttctgttgccgacgtgtatattaacaaaacctatgccggtaatcataagggcgcgtattcagcttttgccattgaaatcagtaaattgttgaaatatggagagtctaatgaaattttggtgaaagtcgataactctccccggcctaatgttattccggtcaataatactttattcggagtgtatggggggatttatcgtcctgtagaattaatcgttaccgaaccggtgaatatagctgtaacggactatgcatctccgggcatttatatcagtcagaagaatgtgaatcgtaaatcggctgatgtaaacataaagataaaacttgaaaacaagaaagcgcaagctaaaaaaatcgtagtttccactacgatttatgagcgtgacggtagggtgaaggcacagcagcaatttcctgtaacggtttcgccacagggaaggcaaatatatgatcaggactttaccatcaagaatccccatttatggcaaggtctggaagatccttatttatataaagttgtagtcaatcttttggcggacgggaaagtcattgacgaagtgagccagcccttgggcttgcgtcattatgagctgaaggctgcggacggaatgtatctcaatggtaagaaagtgcctatgtacggagtatgccgtcaccaggattggtggaagttggggagtgcattgacagataaggagcatgatacggatttggctatcattcgggaaatcggtgccacaactatccgttttgcacactaccaacaagcggaacgtatttatgcaaaatgtgacagcatcggctttatggtttgggcggaaattccatttgtcaatcgtgtcagtacacaggaaagtggcaatgccaaacaacaattggtggaattgatccgtcagaactacaaccatccttccatttatatttggggacttcataacgaagtatacgctccttataattataccgtgtcattgaccaccgaattgaatgacctggccaaaacggaagatccttatcgtcttactgcttccgtcaatggatattctgtggtaaatcaagagtctaacctgaacgctgatgttcaaggtatcaatcattatttcggttggtatggaggcaagattggcgacatagaaaaatgggtaacaggtatggagcagaatttcccagattaccgggttgttttctctgagtatggtgccgaggccaatattcaccaacaggaagaggcagtaggcgaagtcggaagatacttttctcaattttatcctgagacattctctactaaatttcacgaaattcagtgggggggtaatctccaaacacccttatttggtagcttcttatatttggaatacttttgattttgctactccggccacggcacagggtggcgtaaaggcacgtaatatgaaggggttggttacttttgatagacaaacaaagaaagatcctttctattggtataaagccaattggagcaaagagccggtgctttatataacccaacgaagagctactgagcgtgagaatgaagtgactcccgtaacggtgtattgtaacgtaggtgttccccgtttgtttgttaatgggacagaagtgaaaacagtcagtaaaggacagacttcggtacattatatttttgaaaatgtgacattgaataaaggggaaaatgtaattgaagcccgagtggatcatcaagggaaaactcttgaagataccattcgatggagttattcaccggaaaataaaaatagacttaatttgtccgatccgaaagagaaaacaaaggaacatgtcggactctaattcgtggtggattttttatacatttaactcaaaactaaatttaaaatgaacgaaaacatgaaaaagtgtttttatattttatttttatttctgtcaatgcccctttgggcacaagcacagacaagacgggcatccattcccttgcagcatggagctcatagaataggtaaccgtaccgatgcagatatggaacgttggcgtcagcatggactgggacaattcatccattggggagtatatgccattcccggtggcttttgggaaggtaaatgctatcccggagctgccgaatggatacgctcgtggaaagaaatgcctaaagatgcctatgatagcttgtacaaacagtttaaccccacttctttcgatgcaaaggcatgggccaaacaggccaggcagatgggggcgaattatatgatatttacaacgaagcatcatgatggtttctgtctgtggcctagtaaatatactgattacaccatagcccatactccctataaaaaagatgtagtgaaacaaatagtagatgcctataccgctgagggaattgatgtgcatctctacttttccattattgactggaaccataaaggttatcgtcctgcacctccagaaacccggcaagatagtattgcgtatgaaactttcaaggagtttacccgcaatcaattgatagagttgctgactgattaccctgctatcaaaggattatggtttgacggcagttgggataaagcctggatgaatgaagcggcgtgggtggatactttaggtcttgaattgagaaagctccatccgggactcatcattggcagtcgttttcgtgccgatgaatatggaaaacggcattatgattctaatggagacctgattgatgattatgaccagacttgggaacgggatttgccaaactccctagaagacctgaatggtagtgattgggattgtgtgatgaccattcctgaaaatcaatggggatatcatgctgaatggcggggatacgtaaagacatcatacgatttattggagatgatggtgaaagccgtttctctgaatggaaattttgtactcaacttcggtccagacggaaaagggaatatccgttcggaagaaaccaagctagccaaagaaataggggattggatgaaaataaataaagaagccatttatggtacttcccattcaacagtacagaaacaagattggggatactttacgcagaaaggcaataaattgtatatgtgcgtattcaaccgcccgattaataacctgctgaagatagaaataccgaaaggtggaatcatacccatgaaggcttatttcctagaaaataatcaggaaacggaaattcagaatgcaggtaaaaacaagcggaacagttccttgtatcatgtagctgtacctgcttcatataaaactgaccgaccttttgtcattgtcctcgaaatgcaggagaatacgaaagaggaaggtgaatatcagcaggctaaaatataattattctcattttatttgttccaaaagatcgtttagtaaggagatttggcgggatttttttaattttgcacttacaactaattaacagataagaaaatgccgttaaatttacccgataaactacctgctattgaattgctgaaggaggaaaatatcttcgtcatagacaattcacgtgccagtgcacaggatattcgtccgttaaaaatcgtgatattgaatttgatgccgttgaagataacgacagaaacggatttggtacgtttgctttccaacactcccttgcagttggaaatatcatttatgaagttgaaaagccatacatcgaaaaatacgccggtagaacatatgaaagcattctatcatgactttgatttgatgcgcgacgagaaatatgacgggatgattattacgggagctccggtagagcagatgccgtatgaggatgtgaattattgggatgagattactactatttttgattgggcgcgtactcatgttacctcaactctttatatttgttgggcggctcaagccgggctttatcatttctatggagttcccaaatatccgctgaaacaaaaaatgtttggtattttccgtcatcatatcaatgtacagggattgcccatattccgtggttttgatgatgagttttttgtaccacatagccgtcataccgaaatacaccgtgaggatattctgaaagtaaaagagttggctttaatagctgagtctgatgagtctggggtttatatggctatggctcgtaatgggcgtgaattctttattaccgggcattcggagtattctccttatacgcttgatacggaatataagcgtgatttggcgaaagggttgcctattgaaatgcctgtaaattattataaggacgataatccggacaatgccccggtggtgcgttggcgcggacatgccaatttgttgttttctaattggttgaactattatgtatatcaggaaaccccgttcgatataaatcagatacgatgatcagacaacgaaaaatagaattattagctcctgctaaaaatctggagtgcggtattgcagctgttgatcacggtgctgatgccatttatattggtgctccccgtttcggagcacgtgcggctgcggggaattcattggaggatatcgctgagttggtgcggtacgctcatgtgtataatgttcgtatctatgtgacggtgaatacgattctgaaggatgaggaactgaaggatacggaaaaaatgatttgggatttataccgtgccggagtggatgctttgatcgtgcaggatatgggattgttggaattgaatctgccacctataccgttacatgccagcacacagatggataatcgtactcctcaaaaagtaagattcctggctgaggcaggtttccgtcaggtggtattggctcgtgaactttctcttgttgaaataggaaatatccatcatgcttgtcctgatgtgcctttggaggtatttgtacatggtgctttgtgtgtaagctatagtggacaatgttatgttagtcaggcttgtttcggacgtagtgccaatcggggagaatgtgcccagttctgtcgccttgcttttgatatggtagatgcggacggtaaatctatagtaaggaataagcatttattgtctctgaaagatttgaatcagagcgaagagttggagcaattgctggatgccggagcttcttccctgaaaatagagggacgtttgaaggatgtatcttacgttaaaaatgtaacagcttattatcgccagaagctggatactgttttcaaacgtcgtaaagagtatatccgtgcttcatcgggaaaagtgaaattagagttcaaacctcaattggataagagtttcagtcgtggttttactaattattttctttttgacaggaataaggatattttttcttttgatactcccaagtctttaggggaggagatggggacagtgaaggaaattcgtggtaattatcttaccgtagccggaatcaagtcttttaataatggagatggcgtctgttttttggatgagactggtaagttgcagggatttcgcataaaccgggtggagaataataagttatttcctcaagagatgcctcggataaagccccgtacgatactttatcgtaattttgatcaggaatttgagaggttgatgtcgcgtaaatcagctgaaaggaaaattgctgtcattttaaaattggctgaaaataatcggggctttactctgtctctgaccgatgaagatgatcacagtgccagtgtggtgctggaaagggagaaggaacgtgcccgtactccgcaggaagataatttgcgtacacaacttggaaagttaggaaatactccatttgaagcgtcagatatagtgattgactggtcggacaattggtttattccggcttctatgcttgccgaacttcgccgtaagggaatagagaaactgctggaagtgcgccgtattaactatcggcaggaaatttataagttgcctcgaacgcatcatgcttttcctgtgaatgaattgacttatttgggaaatgtgatgaatgctgatgctgtttccttctataggaatcatggcgtgcagcgtattgctccggcttatgaaaaggctccggcagaagaagcggtattgatgttttgcaagcattgtttgcgttatagtatgggatggtgtccctcttggcataaagtgcgttctccttatagggaaccttattatttggttagctcggataacagacgtttccgcttagagtttgattgtaagaattgtcagatgaaagtttatgctgaaaagtaagtacatcggattactgtttttggtgttggctattttaatggcttgccaatatccttcacctgttacttcgagtggggatatgccgcaaaagaaaagggattctgtcaattatttgatggaacggcattatacattaaacagtaattttgaggttacttcagattcgcttatgttacagcaactgccattggttgatgtgcttcctgtttttaaaggagaacggctggtggtagcggagtttatgatacaagctgctgatagtgtggattctgtatgggtaaaggtagcacgggaccaggaaacaatgggatggatacatgaaaaggaattgttggagaaagtagttcctgtggattcagtgtcacagtttattcattttttcagtaattctcataccatcgctttctttgtcatattaggctttttcggtatttggtatattcatagggctattcgtcgccagaagctgcaattaatctggttgaatgatattgatagcgtttttcctacagttctttcttggttggtagctacagcagctacgctttatgccagtattcagcattttgttccgggaacttgggagcagttttattataatccttctttgaatccttttagcttaccttttattctttctcttttcatgtttaatatttgggggattattcttgtggggttggctactttggatgatttgtttcatcagacacatattgaagctgcatgtttttatttgttgggattgatgtcctgctgtatctttttatatttgttttttacatttactacgtattactatttgggttatccatgtttattggtatatgctgtatggtcatttaatcgtataaagcatgcttcccggtataaattcagttgtggaaattgtggggcgaagataaagaataaaggagtgtgtcctcattgcggcgctgtcaatgaataattttattgtttgtttcttttgacaaaggctcaagcagttttctattgtaaacagcattttctctatgtacatacactaaaacaaataggtttgttctagaagctatgggtatcatttacagcaataataaagttcttgcttttcttggtgtgacagaataaaaaataaatttgatttggtaaatgtggaaacagaaagggagttcgtgatgaaccccctttctgtttttgcaagaatggttagaagtgataacgtatatccactcccagttgtaaaggcctgcttttttgttcgaatcctctatgcatggtttcaaaatagaaggttgtataatccttgttggttaaattacgtccccatacatctatctgtaaagcttttgtgtgcaaagaaatgcgcccgttcagtgttccgtaaaaactttgtgagacattgtttttttcagtccaataaatttttcctgctccggtatagctcatgcctaaagtcaggctttgcatccaattgcttttatcgaaaaagaaactataatttgcgcctgcattcatggtatggcggggaacaaatggtacataattgccgctataatcaatttgctcttctgatgatgtagtacctccgtcatattttttgaatgtggaatgagtatatccataacttacattcatattcaggtttttgttgatggatgccagaaagctggcctctactccataactttcgctactaccggcattgaccatcattcgtcccaagccactattgacaaatttggcgatttgttggtcgtgggtatccatgtagaatgcggcaaggtcggtcttcagtttgccgttgaacaaactgagatgtgatcccacttcgtaattccagctgtactcgggcttgtagacagttgtttcttgtacgttcaattcttttccgtagttgggcatgtgttgcttgatcattccttctatcatacctgccatagattctggtgccttgtctagtatggcttcaatcattttttgttgcatgtcactttgtatcagttctgaaaacatctgtacgttataacctccggaacgatatcctctggttatgcttacatacatattgtttgcagggctgaaatcgtatttaaaagctagcttgggaagtagctgtacatagtcgtttttttcttttccttccaatagcggtgcagcattcaaattcctgaatggaatattaaggggaggcattgccattttaagaaagaaatcgaaatcaatattactatccgagaaataattcatagacattttttcatattccaagcgcaaacctgctgttactgaaaggcctttcacaaacaggtcgttgaatgtagattggtggtacagtgcggtgctgaataccggtgtgtcaaaacttccacttacgcggatacggttgttcaaaacgtccagactcatttcaggggtacggcggggatcgtctaaatgaattttcttgaaagtattgttgatgtttccttcgatcatatcggtcactccgtcctccatgaagtttaccggaccggtggtatgtagccattgataaaaaccactaacccctgtaacccattgccagcgcttgttgtttttgcttttaaaagtaatctcttcactgatggtattcagacgctgcttctgctcaatggtataaatgctgacaggcaggaaatcctggtccataaacatacggtcgtttaaattctggaatcctgtaacagcgcttaagataaacttttgcgcctggtattcaatattcaaaccggtattgaacagtccacggcgataagtacaatcctgatcgtatgaaatcttccctatgtagtttttatatttttcattctctttgtcgtatccgtctatagctcctgtatagtaataagggtatcccccttcgtcattataatcatagcctatggtgaagtctagttttaagttttctgaaggcagccagatagcatgtattcgtccgcctcccgcttccatattatctacttttttcccattgagcgaattgcggaagaatccgtctgatccctcataataaccaccggcggagaaagcgaaacagtcactccaacggtggtaatgggttaatgaagcactgcggtagttactttttgttccataactcagttttacgtctgttccctgataggagaatggagagcgggtatgtaccttgattagtccccccatggtattgcgtccgtacaaggttccttgtggaccgcgaagaatatcaatacgttctatatcataaaaattgaaatcaaatgcagatttgtcaatgtaagggatattgtccacatacaaacctaccgcaggagtattgatacgcgatccgattccccggatgtaaatggctgaggtgagtcttgaaccatagtcgggcataaagaaattgggtaccagtgaactcacgttctttaaagtggtgatttggtttgcttgcatatctttttgggagagtaaagatacggctgtaggaagttcccttaattttccggtttctttaggtgaagcgataactaccacctcttctatatcaatgacttttgtagtgtccttaggcagcgtgttgatatcttcagcaaaagttgttgcagccagcaggcaggatgtaatgaataaaatgttttttctcatatttattgtttggttttatttgatacatcacggataaccagagttgctacaagtttctaccaggcggaaaatttatatattccactctgtataatccatgatggagaatgattccggctgcaaagtaacggtaaacctgatatgtgtgcaatcctaataaatgaggattttatattctgtctgcttcaatgtagccattcatcacagcataaacggtaagaccggaaacagacttgatgcccagtttttcagtaatgttcttgcggtgggagataacggtggtcaggctgatattaagtttgtcggctatctctttgttgataagtcctttggtgataagtatcaatacttctatttcccggacagacaattcatgttccgttttttctatgtgcattgctttatctgctgcttgttttcttgcctgatgtccatattggcgcaattgatggatgtcttttatcaaagaaccttcatcttggtagatattcagtttgggaacaccggataattgaggctggttgtcacctcctgctaatacaattgtttttggtttacgaagtaaaaagaaggaagtatgttcaaaatagatttgggcagagataaaataatgggcatacatgtccggtgtgtcatccgtcagctcaccaaaggaatggaatacacggatagtagccattggaatgatatcttccaaaatgttttttaaccccaggcaagtgagggtatttgggtctactatggctatttcgggatgatgcatgatgttttctttggtgcaaagatacatatcttttataaaaaacagattcataaagacaaagaaatcttcttttaggcaacatcaccaatcatttatttgtaggggcgcatttgaatgcgcccgcatatgtgctgtaaatcattttcggataggttcaatctgtcattactcctaaataagtggctgctgcttcagcacatttttctccatcgatacctgctgaaacaattcctccggcgtaacctgctccttctccacaaggaaataacccattgacagtgacatgttgcagtgtctcattatctcgcaggatccgtaccggagccgacgtgcgtgtttctacaccaatcatcactgcttcattggtcaggaagccatggctgctctttccgaattgttggaaacctttgctcaaacggtcggtaatgaatgcaggcatccaaaaatgcaggggagaggaaactaatcccggactatacgaactgtcgggtaaatcatagcttagttttttgcgggtgaagtccaccattcgttgtgaaggtgcggtttggcgcatattgccttgctgccagcaggaggcctccaatgcttcttggaaatacatcatggttaatggacaatggtcggtagtccattgaccatgatttttattagtggcttttaattcttcacttttcgtttttaattcttctgtaaaaagattattttccgccagatcttccggcctgatttctaccaccatgccggagttgctccatttggagccgcggttgctgggactcatgccgtttactacaatctgatgcggaccgcttgcggcaggaacaacaaatcctcccggacacatacaaaaactatagacaccacgtccttctacttgtgtcacaaagctatattcagcggcaggcagatactttccacgtccgtttttattatgatattgtatttggtcaatcagcatggacgggtgttccaaacgtactcctactgcaattcctttggtttccatctctataccattgtcatacaaccaccgatacacatcccgtgcggaatgtccggtagccagaataacaggtcctttgaaagtctttccggtatttgtttctatacctgtgattttgtttttttctataataagggaatccattcgtgtttcgaaatgcacttcaccaccacattctatgatggtattccgcatattttcaatcacacgcggcaacttgtctgtaccgatgtggggatgggcatctgccaggatggaggtactggcgccatgttggcagaatacattcagaattttgttcacattccctcgctttttgcttcgggtatagagtttgccgtctgaataggctcctgctcctccttctccgaaactgtagttgctttcaggggcaactttgtgctcacggctgatacgggcgatatctatttttctatcgcgtacattcttacctcgttccactacgacaggccggagtcctaactctattaatcgcaaggcagcaaaaagtccgcccggtcctgctcccacgacaatgacttgtggtttcccatctaccttattatatatagtacgggtgaactcctcatcttgtggcatttcattaatatataggcgtactttcaaatttacatagatggtgcgttgacgtgcgtctatgctcctttttaagatgcgaagggcatggatggtacgtatatccaatcccttgtcatgtccgatgaactgtttcagtgactgttcgttggctgcttgttcaggcaagactcttatttgaaattcctgtatcatggttcttatttggattgttcgccttccggcattaattttttacggtaataagaattggcggtatatagtgcggcggcagggttgtgtcctgtcacacggtctttggtcactaaagttgtagtataggcattagagtacttgtagaataaactgtcatgtcccacacatagtccgataaccacgttcaactctgtatgtgcttggttgagaaggcgtgcttgtaggatagggttacacattgccgcaccgattttttcacattctttggggattccgatagaggatttggctattccggctactttgcagattactgaatatacctcaaagccgttagcacggaggatgcgggcaaaaatacgggcttcattcaccagtccgatacaataggcaattcctagttttttatatcccatcttgcgtgcgaaagtcatgatttcttccacacgggttaatcggcagtaaccttcatattccacttcggcactggctgccattatcttgttgttgtcgttatattgtttcaacgcccattccaaatcttcttgttccaaatgggtagtcagacaaaattcagggtaagtgcgctctttgaacttgcagttctgtgtgccgcagtctatgcaggtcggggggtatgattgttcttttgtcattttatatcattattcaaattaagttttctcttatttatctcatccaaacaaagcccggaacgcttcttctaccttccttaccggaatgatttctatctttaattttgatgtatccattccttgcaaattatgtttcggtataagaatttgtttgaaacctaatttctctgcttctccgatgcgttgctcaatacggtttacaggtcggatctcaccactcagtcctacttcacccgccatgcaggtgtcacgttctatttccgtatccatattgctggatagaatggcactgatgacagacaggtcgatggccggatcattcactttcaatccacctgcgatattcaaaaagacatctttttgtgccagtttgaatcctacccgtttttcaagtactgccagaagcatgttcatacgtcgtaaatcaaatccggtggcagaacgttgcggattcccatatactgccgaactgactaaagcctgtgtttcaatcaagaaagggcggactccttctatggcagaggcgatagcaaccccgctcatcccgtcatggtcttggctaagcaacagttcggacgggttgctcacttggcgcaaaccgttttggcgcatttcataaatgcccagttcggcggtgcttccgaaacggttcttgatgctgcggagaatgcggtacatataatgttggtcaccttcaaattgcaatacggtgtctacaatatgttccagtaccttggggccggcaatgcttccttctttattgatatggccgatcagaatgaccggcgtatttgtttctttggcaaattttaaaatagaagcggaacattcacgtacctgtaccaaactgccgggagaagagtctatcgtttcggttgagatggtttgaatagagtcgatgatcactaaatcgggtcgtgtattcttgatatggacgtaaatctgctccaacgaagtttcacagactatcaggcagtcggaagaattatgcgggatacggtctgcacgcagttttaattgccgggcactctcttctcccgatatatacaatacttttttgtcaggcagatgaagtacggtttgcagcaccaaagtggatttgcctatccccggttcaccgcccagtagaacgagtgatcccggtactaaaccgcctcccaatacccggttcagttcttcgtcgtgcatatcaattcgaggttcgtcccctccggtaatgtcattcagtgtgacaggcttgctttttacggattccaggccggataccggtcttttgtttgcaggttccttgcgtataatttcttctacgtatgtgttccatgcaccgcaagacggacatttccctacccatttgggtgaatcctgcccacagttggtgcatacatatacagtcttttcctttgccatattcttacgggataattaaaacagcgcaacttgaggctgaatttgtacaaaggtaaggaaatagttctgcatatcaacatgggcaggataaaaaagttttgtcttatttctgctttaataaaaagcattcttatattttatcgcaaaaaaatgggaaattgtgatagattgtaggaaattgtttttatatttgcatcgttcaaataaaaaacagaagaagaacaataataaaatgacgatatactatctccatacaaccaccacattagggatggggcacatgacaactacaatgtccacatccacaacaatgacccctcggggttaaggatagtatatgtgtttctacgtgatacacgcttacggacgtaagcaaaacaagcttttaattttatttttttagtgtaaacagatacagtttcttttcgttgtcatgctgggtgaaacaaaagtagattctttaccggacttgaaatggctcggaggacagaatggcaaaagaagctggaataaaaatagataattgcatgaaagttatgaaattcggcgggacatccgtaggttccgtgaacagcattttaagcgtcaaacagatagtagaggcagttgaagagcccgtaattgtagttgtgtcggcattgggcggtataactgacaagttaatcaatacttcgcagatggctgccaatggggattccgcatacgagaaagaataccgtgaaattgtgaatcgtcacattgaaatggtatataccgtaattccggcaggtaatgagcgtactgttttattggataaggtcaatgaattgttgagtgaactgaaggatatttttcagggaatttatctgataaaggacttgtcgtctaaaacgtcggctactattgtaagttatggtgagcgcttgtcgtctattattgtagcttcgttgataaagggggctgtatggtatgactcccgcaacttcattaagactgaaaaaaaacatgccaaacatattctggattccgaactgaccactcgcttggttaaagaaactttccagaaattaccggaagtggcattggttcccggatttatctctactgataagaacagtggtgaagtgaccaatttgggacgtggcggttcagattataccgcttctgtcatagctgcggcactgaatgcggatagcttggaaatatggacggatgtggatggtttcatgacggcagacccgcgtgtaatcagtacggcctataccattaatgagttgagctatgtggaagcgatggagctttgtaactttggagcgaaggtggtttatccgccgactatttatccggtatgtcataagaatattcctattctgattaagaatacattcaatcctcaaggcgagggaactatcataaagcaggaagtgaattccggttctaaagccattaaaggtatctcatccatcaatgatacgagtttgattacggttaccggtctgggaatggtgggagtgatcggagtgaatttccggatttttaaagcattggcacaaaacggcatcagcgtgtttatggtatcgcaggcatcttccgagaacagtacttctatcggtgtgcgtaatcaagatgcggcgctggcttgtgaagtgctgaatgaggaattctccaaagaaatagaaatgggggaaatcagtccggttgttgccgaaatgaatttggctaccattgccattgtcggtgagaacatgaaacatacaccgggcatcgccggtaagctgttcgggactttaggccgtaacggcattagtgtgattgcttgtgcgcaaggtgcttcggaaaccaatatctctttcgtggtagaatccaagtcactgcgcaaatcattgaatgtgattcatgattcgttcttcctgtccgaatatcaggtgctgaacctttttatctgcggtacaggtacggtaggaggcagtttgatagagcaaatccgttgtcagcaacaaaagttgatgcaggaacgcggtttgaaactgaaagtggtaggtatagccgatggacatcatgcgttgtttacccgtgcaggcgtagacttgtcacattataaggaagagttggcagagaaaggaatgccttcgtccacccaggtgttgcatgacgagattataggtatgaatatattcaactctgtgtttgtggattgtacagccagtgccgaggtggcgtctttatataaagatttcctgatgaataatatttcggtcgtagctgccaacaagattgccgcttcttccgaatactccgtttacagtgaactgaaacaaatagcccgccgccggggtgtgaaattcctgtttgaaaccaatgtcggtgcgggacttcctattatcaacacgatcaacgacttgataaacagcggagacaagatcttgaaaatagaggcggtattgagcggtacgctgaattacatctttaacaaaatcagcgcggacattcctttcagcaagaccatcaaaatggcacaggaagagcgctactcggaacccgatccgcgtattgacctgagtggcaaggatgtgattcgtaaactggttattctggctcgtgaagccggatataaattggaacaggaagatgtggaaaaacatctttttgtaccgaatgatttctttgaaggcccgttggaggagttctggaagaaagtaccttccctggatacggattttgaatcacgccgtcaaaagctggaggatgaaaacaaacgctggcgttttgtagccaaactggaagatgggaaaggcagtgtgtctttgcaggaagtggacagcaaacatccgttctatggtctggaaggcagcaacaacattattctgcttacaaccgagcgatataaagagtatccgatgatgatacaaggatatggggccggtgccagtgtgactgccgccggagtatttgccgatatcatgagcatcgctaatatttaggcttatgaaacatattattattttaggcgacggtatggccgactggcctgccgaatcactgggaaacaaaacattgctgcaatactccagtacaccttatatggataagttggccgctatgggacgtaccgggaggttggttacagttgctcccggatttcatccgggtagtgaagtggcgaatatgtctgttatgggctataatttaccgaaggtgtacgaaggccgtgggccgttggaagcagcaagcatcggggtggagttgcaaccgggcgatatggctatgcgttgtaacattatctgcatcgaagatgagaagataaaaaatcactccgccggacatatcactaccgaagaagctgatgtgctggttagatatttggaagaaaaattgggttctgaccggattcatttctataccggtgtacaatatcgccatttgttggtgataaaagggggaaataaacaattggactgcaccccgccccatgatgtgcctttgcagcctttccgtccgctcatggtgaaggcggaagtaccggaggcgcaggaaacagccggattgataaataatcttatcctggcttcccaggaattgttggcagatcatccggttaatcaaaaacgtatagccgaaggcaaagatcctgctaatagtatctggccttggagtccggggtatcgcccgcagatggaacctctctccgggaagtatccggccataaagaaaggggctgttatttcagcggtggacttaatcaatggcataggacattatgcaggattacgccgtattgctgtagagggggctaccggtttatataatacgaattatgagaataaggtggctgcggcattggaagcattgaagacggacgactttgtgtatctgcatattgaggccagtgatgaggccggtcacgaaggagattttaagttgaagcagtttactattgaaaatctggacaaacgtgttgtaagacctgtttatgaagcagtgaaggattgggatgagcctgtggctatcgccgtgcttccggatcatcctacgccttgcgaactccgtacccatacggccgaacctgtgcctttccttatctattatcccggtatagaaccggactgtgtgcagacctttgatgaagtggcatgtgtggaaggcagttatggaatattgaaagaagatgagtttatgaatgaatttatgaaaaaataatgtggcagtttgctaatttgccccaatggcaaccctccatgcaaagcccttggcacattagcacattgacgcattgaaaaattgtttactatgaaatattacagtacgaatcaccaggcttccgatgcttctctggaagaagctgtagtgaaggggctggcttctgacaaaggtttgtatatgcccgaggccatcaagccattgccgcaagagttttatgatcagattgagaatctgtcgtttcaggaaattgcttatcgcgtggccgatgctttcttcggtgaggatgttcctgctgaaacactgaagcagatcgtttatgatacattgagttttgatgttcctgccgtaaaggtaaaggataatatttactctttggaactgtttcatggtcccacattggcatttaaagatgtaggtggacgtttcatggcccgtttgttgggctacttcattaaaaaagaagggcaaaagcaggtgaatgtactggttgcgacttcgggggataccggtagtgctgtagccaatggcttcctcggagtggaaggtattcatgtgtatgtgctttatccgaaaggaaaagtcagtgaaattcaggaaaagcagttcactactctggggcggaatatcacagcgttagaagtggacggtacttttgatgactgtcaggcattggttaagaatgcgtttatggatgctgatttgaatgcgcacatgaagttgacttctgccaactccatcaatgtggctcgtttcctgccacaggcattttattacttctatgcctacgcgcagttaaagaaagaaggaaaagcggatcatctggtagtgtgcgtacctagcggaaactttggtaatatcaccgccggactatttggtaaacgcatgggcttgcctgtcaagcgttttattgcagccaataaccggaatgatattttctaccaatacttacagaccggaaaatacaatcctcgcccttccatagctactattgccaatgcaatggatgtgggagatccaagtaattttgcccgtgtactggcattgtacggtaacagtcatgctgccataacagcggatatctctggtgcgacttatacggatgaacagattcgtgaaacggtgggtgaggtatatcgggaaaccggttacttgctcgatccgcatggagcctgcggttatcgtgctttatccgaaggattgtcccccagcgaaacgggtattttcctggaaacggcacatccggctaaattcctggaaactgtggaaggcatcattggagacaaagtggagattcccgccaaactgcaagcatttatgaaaggaaccaaacaaagtgttccgatggaaaaagcctttgaaagtttcaaaggctatttgatgaaagaatagcttttagaaatagatatctgataagaaaagaggggggcaaaagtccaaagtaactatccaatggttcaccgtaggggcggattgaatagttactttgggcttgtttacataaagaacaaaaagttccgtcacagcaacgtgctcattactagttactttctgtgtaaaagaatctcaaacctccttcaatcggtatgcttccggctatcgaatcctgttacgtatgtaacaaagtttgttcctaccgtatctttcactccgtttcattttcactccgtttcatttgatatttcacttgggtgaagcaactgtttcacttgggcgaaaacggctgttcatctaagtgaaatcgcctcttcacttgggtgaagcaacaaatgcagatgggcaaaaataagccttatgacgctctcctgcaaggaagtaaccgcaactatggcacaggaattagaacaaccgatatacgtcaagccgaatttgatagcggagaatggaaaaccgttttaggggaatttagaatgttttttcacattatattgttgatttacagagagatactgcgcgtggtccggaatggttgatgcgtgtctttattttatttcttccagcaacttcccgaacgaagtgaatgtccgttgtttcccgccccgggtgaggtacaaggcatcgggagcgatgacttgtagatggggcagaccggcaggaacgttttgggtttgcagacaagtatatccgtgacggttcagtgcgttgatagtccagtgcaataaggtttcgtctgtcgcttccaccgttatttcctgctttccattcacggttggatagtagatgccatgatcataatcgaaccggatattactgtgtgagaacagcgtgtccatccgatggttcagaatcatatcttccgtcactccgcattgcagtcctgtttctttggacagcagccaaagcttgtccgacagtaccagggcttgttctatgtcatgggtggatagcaggatggccttgttttgctccaccgccagctgatgcagcaaagtcatgatttctatgcggctcaccacgtccagaaaagcggtcggctcatccaagatgataagcggacattcctgaaccaatgctttggctatcattaccttttgccgttctccgtccgaaagttcggcggtgtagctttcggctttgtgggcaatgcctacggcatccaatgcctctttgataatgagatggtctttgggatggagccgtccgaagaagcctgtatgcggctggcgtcccaaagctaccagttcatacacggtcagccctccggcttgtgtcttgtctgtcaggactacaccgatggtgcgcgaacgttccttttccgaatactgctgcaaaggcttgcccagcaattgcaaatctcctgccagtgaaggttgcgaagcggacagggtgcggagcaaagtcgactttccggtcccgtttgctccaagcagactggtcagttctcccggatagagtccgaaagaaaggtgttcgtgcactttcttttctcctttgtgggtacgataacctatgcacaggtctgtggcggtgatgacagcttgcttttccatcagttgaagtactggattttacgttggttcacaatgacataaataataatgggcgcaccaatgaccggagtgacggcattcagcggaatgatacctgcttcgcccggcagaatgcagatgaagttgcagagcagggcaatggctcctcccgtcagcatggtgacaggtagcagggaattatggttggaggttcccagcatgaggcgggcaatgtgcggcacggccagtccgataaaggaaatcgggccgcagaaagcggtggtcgtcgctgtcagtaatccggtggcgacaagcagcaggttacgtgtacggcggatgttgattcccaggttttcggcatagcgtgttcccagcagcagggcattcagaggctttatcagcagtatggtaatcagcagtcccgccattgtgaccaaggagaaaaagggaagctgctgcaaagatactcctccaaagtttcccattccccaaatcatgtaggaatgcaccccttctgccgtggagaaaaagttgagcagggagatggcagatgaagtgatataccctatcatgatacctataatgagcagcatgatgctgttttttatcaaagtggagaagaacaggatgattcccatcaccagcatggagcctatgaatgctccgataatgacggacaggaatccggataaagtgaatactccggcagtaatcgtacctgcgcctgccagcatgaccaaggcaactcccaaactggctcccgaactgattcccagtatggaagggtcggccaaagggttattgaatgtggtttgcaacatcagtcccgatgctgcgagtgccattccgcaaaggagggcggtaatggcttgcggcaggcgggattcccagactatgaaactccaactcgccttttctacttcattgcctgtaaggatatgccacaccgcctcggcagggatgtttaccgagccgaacaacaggttggctcctgtcaatgcaaggatgaggaggagcagtatgataccgtattttgttcctttgttattcattgatactgtttggggttacgcccactgtagggagtgtgtcaaaactaacccggcctatcccatcgtcagctgtaggggcagcattatccacgttttgacataaccctacggtgatttactccgctaatttagtgaaatattttaattcatacccttctaaaagcgtaggatggaatatttttatcaaatctttcagtaatcggtcgggatggaaaggggaatcttcgtaaaagtctaccttccctgtgttgcatccataaatgttgcgttccttgaatgcacggaaaccggtgtatggagcatagtcctgctccaattccttataagtcttgtcaatggcctgattatatttgatgagccagaagtctgcattctgacctttgtcaaacacggtttcgaaggctaggggaacagaaccgctatgctcgtcatcggcaaacacataattggccccggcatccgcataaatccgcgcggaggtgcttttccctcccggaacataccaagccgaaccgttcttcagttcgctgataacgctcggtgcagatgaaaggggagcaaccaatgctttcagctcattatagtttttttccacctcggcaaacaagctgtccgctttttgtgcctcaccgaacagaaggccgtagaaacgcatccattcggcacgtcccaatgccgaagtttccatgtagtctgcacattcgataatggggatgttgagtttctccacccgtccgtatccgccactgttctcgaaaggggagagcataatggcatcggggtgcaggtcgattatcttttctatatccgggttcattccattccctacatcggtgatgcttcctgtgcggcagccatcctgcacttcttgcagtttgatatacttcaaatcgcagactcctccaatacttttcaaagcaccaatctggttgagcaatccgcaatgtacggatgagtaaacaacggccttgctcaatggcgtgcggacaagtgtcccttccggcaagtcggcaggcagggacttttctttgtcaaccaagacgtaggtatgcagtatccgggtcgtatcccaaggattgcgcaggcgggcaatggtatagtcttcggttgcagacagattgaggttttctgcataacgcaaagggattgctttttctgcttctattacagaagaactcttgcttcttccgccgcaggaggaaagaagggcaagcaagaaggtgaataggattacttgtttcatgttattttttataatatccgccggttttacgggaacctttgtattctattaattctttatctttcagtgatcgtaaataacgctctgtcgtagcagctcctttttggatatattctgcaatttcatatccttttgcaccgggtttcttttccaagaaggtgaggataaggctttcaagttcgtttattccctcatcttcgtttactccctcatcagcgattctgtctattattgaaatgaactgcattcctgccggctcattaatgaattttatattcggctcttcttgaagtgcacgtataatccccgagcccagcccgcgataaggcatcgttttagcacagaaattggcaatgaaaggattgcgtactacggcgcttcccagtttgatgctttccaccgtcagcccatcgggaaggcatcccgggctgataatctctacacggttatcaaaaatgaggaaagttttatgagattatttaatttatgaaggaaataattgtagttttgcttccttcatcaaaagtgaagagaagcaaaaccatattttattatttcagtaagaaggttaatccgcatggacttacccctacatcgtatttgtttgtaaatttgccgtttgccgaatattcgtttacatagccatcagtggtataacttggccatcctccaaccatattgtaagaactgatataaatgtttccggtaaatggattgactgcgatgccacaagggctatcaacaggttgatctattaaattttttgtttcatttcctgtttttgtatctatactgaaataagtattttccgttgcgccataaggagcattgataaggtaaagggtattatcttttacagtcattaatgttgcttccgttacatctgtaacaatattcatattgtcaattttttgtactttagctgatatgtcattataattacccattgctaagacatatacgtttccttccgtagtagaacaaattttagtgggatttagtcctacgggtattctttttgcttctgtaaatgtctttaggcctattttagaaacactttttccatttgcataatctgcaccataattcattccgtctgagttagcaacatacaggtagccgttggccactgtcatctcttctggatttggaccaacttttaatgtagcatcaatagttaggctaagagtgtcgatacgagaaacatatccatcatacatagaaacatatacttttccattagcagctataatatcacgtggaccttccccttgagtggatgtcggaacaatctgtttgatggatttagctgtatttttgtctactatttctataatatttgaaccatatatggcaatatacattttcgaaccatatactattgcatcttgaggggtacctcccaaacttcttttgtttatgtcaaaaaatacattgttgcttgctgttcctttttcaaagttaataaaagaaagtgttccattaacattgttgctaagattacctgcattaataacgtacaagcctgttgcctcggttggcgaagttgcttcaggagtcgtgtcgggttgtgaagaagggtcttcttccggatctctaggaacttcgatctcattgtcatcatcgttacaagcacagaacagcggggctatactaaataaggctgctgcaaaaaataaatgtttgaatttcatacttatataatttttaaaaatgaatactgcaagttagtttatagcttctacccggcatcgggtagcttttcactatgtcatattgtttatttcccaaattaataatatctccccgaagattgtatgtaaacttctttatcttgaagctgcggtataatgaaaggccgtattctatatatccatccatttcattacttggacgattttcggatgcaatataccgtttgctcacacccgtagcatgaagagaagcatttatgaaaggattttccaaggctaaagaagcacctgcgctatgacgtggggtatatgcaatctgatgtttgtaatatacgacttccgggtctgttttatctactgcatattgataggtatagtttccggtcaatagtaaggaataatgttttgccagttggaaagtggtgtttatattggcatctactccccaaatttctactttgcctaaatttaccatattccagataaacatattatagggcattgccacaattttatcttttaccttattataatacccatccaatgtcagactgattgctggtagccagcttgtaaagttgttctggtaagtgatacctatattatattgttgagccttttcgggacgaaggtcacggctacccatccggtcaaagtagttttcagaaaaagtagccactctgaatatgtctttataggaagcccgaaggtatagctgtccgtctgtacaaggtttccatgaaaaagagaaggaaggggataattttcgccggttctcagctccgtttccttcttttgcaccattaagatatatcgatccgagtagtatggcaacagctgttatgttatcagtttgatatcggagagttgctgtttgtaatatagaatgccggtaagggcttgtattgttaggagtattggcatttaggttattatatatgtaatctgccgcataaaccatgctccagtgactagtcggagtatatagtaatgctcctgatgtatagtattctcgttggaaataacggtcgtttaattctcctccggggtattttcctccttcatcgtggtaatgagattggctccagttaaatttcccattgattaacaaagaaagattattttcccaataagtacggtaatgtacttgtgaaaagaaatttcgttcgcgtaacttctcacggcttttcgcgttgtaaagaatgactgcaccgggtaattgctgatttgtatcgtaataataaatctttccgttcagtgtgcttctgttattagggctgatgtaaagattcagttctcctctgtaggtttgaatgttgttgttatagcgtttttctttggaaacataatctccgttgactaaagtgaaaggatataggttatctgccctcataaattcaccagtggtagatgctgaaatcttttcgttaaacttttgttcgtagcggataaggggattaatcatcccgaaagaacctgtctttatctgtcccgtcaagtgattttttttgtttgaaaaatccggggatatgctttgtaattttaaggcggcagcagaagcaactgtacgtgccggtacaaaaatatcttcattgtccccaatggtcagtgaaatttgttgaatattgtcaatagagaaacgagacaagtctatttgtccgctttgacaatcactgagtgtaaccccgtcataaactacggctgtatgtttggctcctaaactccggacggagatagttttcattcctcctgcacccccataatcctttatgttgactcctgagaagcgacgtaaagcatcagcaatatccgtaatgccttgttgttgcaattgcttcttgttgagttgttggaagggactgctacttttaacctgttgcttggtacgttcagctgtaaccgtaacttcatctattttatgcacttttccggtgatggaatctcctttctcctgtgcctgtatttcaagcggcaataggagaaagctgcaaagcagacaaagccatagcttataagcctggttatttcctttcatttaaaaaaacatattaatgaataaataccgcattcttaccgctgctctttcctcgaaagcgacggtcgatgactttacgttttgcaggtcttctgacttactcctgtttacttgccttcccaccttattatatatacaggcagtggcgtgagtggataagtaaacctatccccttatagaggtagatggagcttacagcagcgggactgttcaggacttgcacctgattcccttttcatccgcttcctcgcatcagtcggaggtacgcggaacaaaacatggcaaagatagtttgtttggatgaataagaaaaggaaaatgataaaaaatcctttttttaattagttacagatttattttctcccagcaaaagtaggcgtgtataacggttctttttttagtgacaaaacgacttgattctatccatgttgaagataaaatagaatagtattgaataaaataaaactgatgcttaacaacattcaaatattgattcgctttattcaatacaatcactatatttgttaaatggataatcttaaaatacgtaatagatgaaacacttgaattttattttagccggtttatttttcctgtgcggtctttgttgtcgggcacaagtgcttcctttggaagaaaatgtggtgctgaacaccaaggaaggacaaatcaaaggaaaactgcttttgcccggtggggtgaaaacctgtccggtggtgcttattatagccggctccggacctacggatatggatggtaattcagccattggcaatttgaggaataattcgttgaagtttctggcggaaggcttggcggcaaacggcatcgcttccttgcgctttgacaagcgggggataggaaccagtgcgtcggcaggtaaggaggaagcgaaacttcgttttgaagattatgtgaatgatgtgacgggctggattgattacctggcgaaagagaaacgttttacgacaatcacggtggcaggacatagcgaaggggcgctgattggaatgctggcctgtcaaaaccggccgaaggtgaaaggctatatctcggttgccggtgcggggcgtcctgcctacgagattatagaggcgcaagtggctgctcaacagaatccggaagcggtgcggaaggaggtggcatccattaacgggtccttgaaaaacggcaaggaagtgagtgacgtgccggcttatctgcaatcattgtatcgggcttctgtccagccttatttgatttcctggttcaagtataatccccggacggtgattgcttccgtcaaagtgccggtcctcatcgttcagggtaaaaatgatattcaggtatcggtggaggatgccgaacttctgaaaaagggttgcccagctgccgaactgcttttgattgataagatgaaccatgtgctgaaagattgtgaatcaaaggccgtacagcagcagatgcttacttacgggaatccttctctgccggtgaacagtactttgatagcttctgtcagtacatttgtgaaaaaactgaaatgatatgggagaaataaagaaacgtttgccgttgcaatgccctgcgtgtgatgcaccgttgagggagattcatttcggtccggcacccaatcctgtctggtgtgttatgcggcagagcatctgatggtgtggctgttgtgtcgcatgttggtaagccatctttatggataaaataaaaaagaggatgccaaaagtcttgttgaagctttgacatcctcttctatgttatactgatgcgttatttaatcttttctcgaatcttgctaagataggcacgcatccccgcagcatctttcttgttgatgatatccaacagctcatttaattctgtacggataccttctacctgtgcaggggtgcggggattgaataaaatttcctgcaacaggtagtcgtcttcgttcaatactcctttggctatcttcatgtggcgtttgaaagtagtaccgggagcgtcctgatgcttcatcactgccgcaaaaacgaaagtggaaacaaaagggatggatagcgaataggccactgtctcatcgtgctcttcaaaggtatattcaaagatgttcagaccaaggttttggtataagtccttgaagaagattttacccagatggtcgccttcgctgatgatgatggcattttcggtgctcagtttgtcaaggttggcaaatgtgggaccgaacatggggtgggtagatacataacggaatccgcattggtcataaaactctttcagtccggtctttaccgaggcaatatcgctgatgatgcaatccttggggagagcgggcaatacttggtgaaaagcatccagcgtatatttcacggttgccgcattgataaccagttcgggcttgaattcttcaatctcttcgagtgtggtatatcggtaggtgttgtaaacgaaacgaaggcgtttcgggtctacatcaaatacagcggtttcgtgctggaagctcaatacatcggtaaagaaggagcccattttaccggctcctaaaattaatattctcatcggtttacttatttatgatttccatttgttgccttacgctttcttcgtggatggcttcgaatacttttttaatgaattctgaatccatgccgcacaatgaaccttgtgcaccgcgcttgtccagaatctcattgtaacgacctgtctgtagaatggtcatatcatgttctttcttgaatgtaccgatttcacggcagacacgcatacgttttgccaatacttcgataatctcattgtcgcaatcatcgatttggttacgcagttcacccaggttttcagttgtttgggtttctttgcggatgaccagcagatttaggatgtagtccagcacatcgggagtgacttgttgggcggcatcgctccatgcacagtcgggattgcagtgtgattctacgattaagccgtcaaaacctaagtccatcgcctgctggcagaggggagctaccaactcgcgcttgccaccgatatggctggggtcacagaaaataggcagttcgggaatgcggcggcgcaattcgatagggatatgccattggggtaggttacggtaaatctttttatcataagaagagaatccgcgatggatagcacccagttgcttcaaacctgcattgttgatgcgctcgaaagctccaatccacaattcaaggtcagggttgacagggtttttaatcaatataggaatatccacacctttcagtgcatcggcaatttcctgcacggcaaacggattggcagtggtgcgtgcgccaatccaaagcacatcaatacctgcctttaaacattcataaacgtgtttggcagtagctacttcggtggcaacatacataccggtttcctgtttcacacgtttcagccatgccaggccatctacaccgatgccttcgaaacctcccggtttggtacgcggtttccagatgccggcacggaaaatcttaatgcctttattggccagcatagtggcggtatccattacttgttcttcggtttcggcactacatgggccggcgataatcatcgggcgtttcttttcaattcccggaagttcgatgggttttaaatctaattccataatctgatattttgttttgttacattatctttttaattctttccagtgcttctgccagcttttcttctttggcacagagggaaatacggatatagcgtttgccgttgctgccgaagataaagcccggagtaatgaacacacgtgcttcgtgcaaaactttttcggtcagttcttctacatcattgtaagagtcgggaatgcgtccccaaaggaacatacctacctgattgggatcaaagctacaaccgagtactttcataatctcttctgccagttggcggcgacggctatatacattgacgttcgcttcttcgtgccattccacactgttgttgtaagcttgtgcggcagccagttgcatggggcggaaagttcctgagtcaatattactctttattttcaatatccattgtataaactgcgcattggtggcgagcattcccacacgccagccgggcatgttgtggctcttgctcatagagttgaactcgatgcagcattctttggctccgggcacattaagaatactcagtggtttcttgttcaggataaagctgtatgggttgtcgtttacaatcacaatattatggcggcgtgcaaagtttaccagcttttcatacagttccatcgtggcgttcgctccggtcggcatattgggatagttggtccacataatcttgatgcggctcaagtccatcttctccagttcatcaaaatcgggttgccaatggttgtcttcgcgcaggttgtagttcacaatctcactgcccaatattttatttaaagaggtgtaggtaggataccccggattgggaaccaatacctgatcacccggattgaccaatgccagcgtcacatgcaggataccttctttggaaccgatgagcggctggatttcggttgccggatcaagctctacatgataccaacgcttgtaccagtcggccatggctttgcgtaattcaggaatgccgacagtaggttggtatccgtgcgcatcaggacgctttgcctgttcgcacaacacattgacggtttcttccgaaggaggcatgtcagggcttccgatacccaaactgattacattcttaccttcggcattcatttgtgccacttctttcagtttacggctgaagtagtattcgctaacattcgccagacggtctgccggctgaatattatatggttgatgttccttctgcatattctcctaatattttaagttcttttgtcaatggtgaaacggcgtcgatagactgcttgtatcttaaataatcattgaaaattacgtctacatagaacagatattcccattcgcggcctataatcggtaatgattgaatcttggtcagatttattttatagaaagaaaagatagagagcacttgagacaggcttccttcgttgtgggggagggagaagacgatgttggccttgtttactttcgaacgttcacgtaagtcatcggctttccatgggtcggccactacaaggaaacgcgtgaagttgtgtttgtttgtttcgatgccttcttccaatactttcattccgtacaaatcggcggcgtatctggagcagatagcggcgtgtcctttcagattttcccgtttgatggcttccgcacttcctgccgtatcttccgtttctactattttcagtttgggatgttgtatcaggaattcacggcattgtgccaaggcaacggggtgggagttgacttctgtcagtgtttcccaattgtcgtccggcaagcacatgaagctgtgtttgatgcgtagtttgtgttcgccgacaatggtcatgccgctttcgcgcagtaactcatagttgtgcagcaaactgcctgcaatggtgttctcgatagcgagcataccaattacattgctatcctgctttatgttcgcaaagacttcttcgaacgtggaacagcagattagttcgatctcttctccggggaagaacttgtgggcggcaatgtcgtgatacgagcccggtacaccttgtattgctatctttttcattcgtatatatattataaaaaaatcccgcttctgccggaagcgggatttcgttgttattatcgcattgttttaatcattgtttaacgtacacatacaaactcccgcttcactttgttgctaaagtaaaagtaataaaagaagaaaaagtatgtattgtataatgctttcattttgttcttattgttattgaatacgctgcaaaagtaatatatttctagtaaaaacaaataaataagaagctttttttcaatttttttttaggcagtgcctgtttggctcctgctttccataattcccggcatctgttgtaaagcccaatctactaatccttctatatgtggtattaagcttttccctctttctgtcagttcatattctactcgcggcggaacttcggcatacaccttccggctcactagtccgtcagtttccagtgtgcgcagagttacagtcagcatacgttgtgagatatcggctattgttttatgaatgtcgcagaatcgcatggttccgttagcatttaatgtgataagaaccagcatagaccatttatcaccaagcctgcacaatacattccgtatagggcaattattatccggatgaaaatttttcattttttaatattctctatttgcttgccgttcaacaatggttacctctatgtaagttccttatctacaggtgccttcttgtttttgggaaaaaggatacttacatttgcgtcacaaaagtaataaacttactcaaggtaactattgttttactagataaatttattgtttcacttataataagttaagattatggcaaagaaagtagctgttttagcggtaaatccggtgaacggattcggtttgttccagtatttggaagcgttttttgaaaatggtatatcctataaggtgtatgcagtggcggaaacaaaggaaattaaaacaaactcgggcattgaattggtggccgatgatgtgattgcaaatcttatagggcatgaagatgattttgatgctttggtttttgcctgtggggatgcggttcccgtatttgctcaaaatgcggataagtcttataatgtggacttgatgtcggtcttgaaggcatttgccgggaagggaaagatcctgataggtcattgtgctgcaggtctgttgtttgattttgctggaattacagagggaaagagattagctgtgcatcctttggcaaaaccggctgtaagtaaagggatggctactgatgagagatcggttgttgatggtaatttttatacagcacaaagtgaaaattttgtttggacaatgatgcctcaggtaattgaagccttgaaaaaataagggaatattaatgtcgcccaatgtagaaatttcctatatttgggcgacaattcctaaaaatagaaacaatgaaatacaattttgataaagtgatagatcgcagcggtacgtctgctgagaaagtagaagggctgaagcatatttggggacgtacggatttgattcctttatgggtggctgatatggattttgccacagctccttttgtaacagatgctattcgtaaacgttgcgaaaatgaagttttagggtataccggcaaaccagatagctattataatgcgattataaactgggtaaaacagcgttatgatttgatcgtgaccaaggaagtgataaattttgttcccggcattgtaccgggcatcggtatggctatgaattgttttactcagaaaggggataaggtaatgattcaacctcctgtttatcatccttttgcatgggttactactcgtaatgagcgtactttggtcataaatccgttgaaatgggagaacgggatgtaccgtatggatttggatgcttttcgtgaacaaattaaaggttgtaagctctttattttatgtaatcctcataatccgggtggcgttgtgtggactgaagcagagttacgagcgatagctgatatctgttatgatgagaaagtattggtcttctcggatgaaattcatgcggatttgactttacctcctcatacgcatcgtccttttgctactgtcagtgaaaaggctcgaatgaactctgttacttttatgtctcctagcaaggcttttaatatgccgggactatctgcctcacatgctcttatttttaatgaagatttgcgtaaacgcttccgtatctatatggatgccggtgagttggatatgggacatgtctttgcttttctttctgttgaggctgcttatagtcatggtacggaatggcttgaccaatgtttggcgtatatacaaggaaatatagattttgtcgacgaatttttgaaaaaacatgcacctaaaatcaaggccattcgtccggaggcttcttatttagtttggttggattgccgtgaactggagttgagccagaaagatttgaatgaattctttgtagataaagcgcatttggcattgaatgacggggaaatgtttggtaaggaaggcattggctttatgcgtttaaacgtggcaagtccgcgttgtatcattgaaaaggcgatgaaacaactggcggatgcttatcaactatatataaagtgattattttaagtattgcgtcttaaagatattcacgcataaaatgaagatggataacaataacggtccgaatatgacacccatgaatccgaataaggaaagtccgatgaccactccaaaaatggtgatgagtggatgggtgtctgccatcttcttttgcagaataaaacgaattagattgtcaatgtttgttacaattaatccacaataaagaagtagtccgacggcatgtgtccaatctcctgaaagagcaagataggcggctagcgggaaccataccaatgctgttcctacaataggaatgacggtggcaaagcaggtcaggaagccaaacaatagcgcgctgggtacatcaaacaaatagtagcctaatgtagctattcctccttgaatgactgccagtaagggaatacctattgcattacttctgacaatcatattaatttctttcagtacattttttttgtttgtatcgctgaaaggaagtaactcatagatgtatttttccatttgaattccgccaatcagcatgaagtagagaataaagaccaatacgaaagcattaacggcaaagctactgatacttcccatcagaaactgtccgatggcaggaagaatggaggctatggatgaaatgttttctgtgcttagtaagtcatatcccgtcttggtatgaagccaatcggcaagattggttaccgtatggataaaacctgtcgtatctacgtttaccgtctgtaatttattgatcagtaaccatacagccaatgataaaggtacaagaaagcacatgatggcttctatcaagagtaaaatggctgtaatactttttttgaaatgtttttcttgggtaagataaaacatttgttttcttaccatgatgtaaatggtgcatgctcctaaaatacctcccatgaaaggagacatttttataaataaaataagtcctaatcccagtataatggtgataagggaatatttccaatactgttcttttacgctcatgtgttttttgcttattttgtatataaataaacaataaaacgaattgaaatgttccgcttttaaaacggaacattcttagtcatgttttcataattattgtattgaccgctaatattcatttcattttcaggagccagttctattgctttcttcatatcttccacagatccgtctttgtctcctttaagtaatttgatacgtcctcgttcatgatatgctttggcaaagttggggttgatttcaatggcttcatcatatacagccaatgctttgtcaaaatctttgtttaccagatatagttctcctgacaggatataggccttttcattgaacggattgagtgacaatacttgattaaaacattcttgtgcttgttccggttcattggtggcggctagaatttctcctttcaaaagcaaggcttgttcgtcgtcgggattgaggctgagcaacttttgtatatcttcggcagcatcttttgcttgtttcattttccaaagtacttcagcgcgtagctggtatgcttcggtataatcttctttcaatacgatagctttagtcagcatagcgatggcggtgatatcatctttcatgccgatagctgcttttgctgtcaaatagaaagataggggggtcttattatctaaaaccaaagctttttggcaggcatccttcatattttcgtaatcttcctgcatatagcagatgccagctagtgaaaggaaggtgtttacttgttcaggatcttttgtagccatgcggtctagtgtgatacgggcatcatctagtcggtttgcctgtgtataagcagtggctagcaggctgagtgtttccaattcatcgttgatggcaactgcttcttcaaaacatttaatggcataaggtagtttacccatacgttgggcgcggatgccgtcgtattttaaaatctcgaagttctttttatcatttttctctttttcggtttcgggggtgttgtttccgccgaataaggatttaaataagcccataatttatagttgttttatttgtctattgttataataaatcgtctgaggtaaatttcttgttcctgatgctgcatgttggtaaaacgtactgcctttattggtttttgttgtaaactggcagtcagtcggttgttttcttgtgtaaagtttactttactccagtcttttccatttgcagatatctcaagacttccccaagttgcgatttccggtttcccgaaatctatctctatattttctccgggataaacttgatccagttcgatagtcaatgaaccattaccgggccatctgataacttccagcgccggagaaatctgaatgcggtttatctttacctgtaaaggtaagttctttatctgactgatatcgcttattagtttatgcggcatatagtcggtttcagcattcagcagtgtgctatatttttggttatagcattgcgtgacggtggcgaaagtttgatcaatcaatggcttgattactcttcctgctgtctttatacccggttggtaagggttttggttgtatgtctggtcaatttgaaacatttgttgttgcaaggctttcacgtgcttgtatttacgcataaataaagattggtcatttttgtcgtatgctttgaccattgccagtacttcatttccggtttcacccaatagtttgaactgataaagccaaggcatgatttctactataatcggatttttatcagcatgggcgactaaaatatcacttgattcaaccatctggctgaaggtttcttgtagaatagagaagtctttttcagtgtaagttttattttttatgtaactttcagtaaagctctgcgctgtgggttggagatttacagattcctctcggcgatatttatgtccgttggggcccaagtccgaattatgggcggcaaagaattccagttcagtggcagcatcgggcaaaatgttcataatagcgtctttccaagttttttcactgttgtattttgttggattccaagcgtatgaggctacactataaatggctattttagaagcctcggcatgttccatcggattagttacaaagccagacatctgattggctatttgagtatcgtttccatatactggtcccatgagcagatgatctctaacgtaatcggaaacaggaaagttccaccatatatatgccggacgtttaatccgttcgtttatccattgaataccatcttgggtaatatcggaaataacccggtctcctgtccacataatttgtatggatggattcagtttgtctcctaaagtagtaagatatcctttagcagggtcggaccaacttttattgtattctgtaggacacatgataaggggagttacatccggttttacttttacaaaatgttcatctatgtaattcagcagttctgcttgtttcacagggttggtaccttctcctgaaatatcatcaaagaagacggcaaaagaacggacaccgagatgatacatcttttcaaattttgccaataataattcacggtcttccttattccatttgatgtcttgtcccggatggatagcccaaacaaaatcgacttcgttttcttgagctacttttactaattcctgtaattgttttgcttctttttcggggtaaggcagacgccagttgggagaactatggtaagggtcatctttaggaccgtatatataggtgttcattttgttttcaccataaaattgaagttggcgaagacgggcattatggctccagggggtcccgtaaaatccttctacgacaccacggtagcgtatggccggatagtcttgtatctctattaccggtaattggttatctttgagcaattgttttaaggtttgcaaggcatagtaggttccacgttcatcgtttcctgccagaattatttccttattattgatggatagataataaccttccttttggttggggatctgacgagtaaacttgcggatggacttgtctcctttttctcctatataaatgcgcaaaccggtattggccgggtgttttccacctaataaatcttttaattcttgtacggcatatggattggcttcagtttctcccaagagttggtaagtttcaggtaaattgatttgtccgtcttgtttggaaacttgttgagggatgggctgtacatctatgttttgggcaaagatagtacaaccggtaaaaagacaaatgattgccaaatgcatttttttcatgttctgttggggtaaaaggttaataaatcaatggcaaagatacgatttatacagaaagaattccatcttttaattgtattatttcttcggaaagtaggtaggagagtaccttttccgctttttcacgattgctattcaattggttcagtagttctgaagcaggcatggcgcctgcctgcaatagctgtttgatttgttgttccaattcttgaaattctccctgttttattcctgaatgatgtttgttaagacatacatcacattgtccgcagttgtgttcgttcttttctccgaaatatctgagtagcattcggctacgacatttatcatcggctgtggcatattctatcatagccttgattcgggtggtatagctttttttccggtcttcgtatatttcccgagttagggcaaggcgattcttttcttgccgttcacgggtatatataatataaggtgtctttttccgtggaatgtaatgtatgatatgtctacgagtcagcgccagtagaatttcatagattcgttggcgggttaatccggagcggattactaaggaatcttcgttaatataggcataatcagtaaatagtcctgtataagaacgcaagatgatgtttatcagtttctctgtatctgtatcattctcgtgtagtttatagagttcgtcgcgtttcatcgtgaaaagaatacgtgaagcattatcttgctcgtctgtatattctaaatatccggcacgggtcagaatctttaaagcgctgtcggcttgtacggggaaatgtttgaagttacgacagaattcatccaagttaaaagcaaaggtgcaacccataccgtctcccatggccatttgaaaatagtagttgatatcttcgtacacttttcggatataatccttgtcgggaaatgtatcactgatacgtttgttgagggtggttttatcactttgggcgtatagcaggacagcatatgctttctgcccgtcgcgccctgctcgtccggcttcttgaaaataagcttcaggagaatcaggcatatctatgtggataacgatacgtacatctggtttgtcgatacccattccgaaggcgttggttgctaccatagtacggctttctccggtgagccagcttttttgacgttgatcttttacatcattattcaaaccggcatgatagaaagtggcagttatgccgttattgaccagtagttcggcaatttcacgtgtacgtttccggttgcgggtatagacaatggcgcagccgggcacactatttaaaatatgtaatagctcttcctgtttattttctgtaggacgtacaatgtaagccaagttttttctttcgaaactcattcggaaaacctgactgtcttttttaaagtttagctttgtttgaatgtctgttactacttccggagtggcagttgctgtcagtgccaatacaggtatgtcgggaaggagttcgcgaatttctgcaattttcagataagcagggcggaaatcatatccccattgagagatacagtgtgactcatctaccgtgatcatgcttaccttcatgttccgtagtttgctacggaatatttcagtatccagcctttccggagaaatataaaggaatttatagtcgccgaagatacagttttccaatgcaacaatgatctcttcgcgtgtcatgcctgaataaactgccaaagctttgatacctcggtcgcgtaaattgcgtacttggtccttcatcagggcaataagaggtgtaataaccaaacataatccgggttgtgctaaagctggtacttggaaggtaatggatttgccgccaccggtaggcatcaatcctagcgtgtcgtgaccgttgcctatactttcaatgatttctttctgtatgccccgaaagtcatcatatccccaatattgttttagaatttctttataggtcattggaagggaaataagaaaattatgtcaaaactccaatgacttatcatcttattattctgataagtgtctgataacgtcattaaagttttgacatatttcaaagataaatctttatcattattcctcactgggttttatatcttctatttgcaattgtacttcaccacgtttgtgcgtattctcttcaatggtataacaaatatcaaaagaacgtttggtcttgatatagcgtgcttgtgaactttgtccgaaagcgatgccattcatcacattgtttgatttattgtctaccaattccaacttgatgtgttcctgatcacgccctactactttgctggttccataatcatatacattatgtgtacaaaagattggtttgtggttgtccggtccgaagggattgaactttttcaggtcggcatggaacttcggagtgatatcccggaagtcaatttctgcatcaatatcaattacagcactggtctgttccggcaaaatatgttctgtgacataggtttcaaaacgacgggtgaattcttccacattttccactttcatggatagtcctgcagcataagtgtgtcctccaaagttttccaacaagtcacgacaatgttcgatagctttgtagacatcgaaacctgatacggaacgggcggaaccagttgccagattatctgtacgggttaatacaactgccgggcggtaataaatctctgtaaggcgtgaggctacgataccgataacacctttatgccacgcttcattatagatgacaatggaacgccggtctgctagtccttccaagtggtctacaatttggttggcctcttcggtcatggtcttatccagatctttacgggtttcattgtattggttgatttggttggctttctccaatgctgccgagaagtccttttctatgagcagttccaccgcctcttttccgttctgtatacgtccggatgcgttgatgcgcggacctatcttgaatacgatatcacctacggtaatttctttttctgataatccgcatacatcgataatagctttcagacctacactgggattggaattcaactgctttaagccgtggtgtgtcagcactcggttctctcccatgataggtacgatgtctgatgctacactgacagcaaccaaatctaataaaggagttagttgatgaaattcaatgccattattcaaagcgaaagcctgcatgaacttgaagcctacaccacatcccgaaagatgatcgtaaggatatgtattgtcagcccgtttggcattcagaatagctacggctggtggcaatatatcatcaggcacatggtggtcacagatgatgaaatcgatacctttttcttttgcataagcaatttcctctacggctttaataccgcaatctaacacaataatgagttttacacctgtttcacaggcataatccactccttttactgatactccgtagccctcattatatcggtcgggaatatagtagtcaatgttcgaatagaactgctggagaaatttgtataccaatgctacagctgttgtaccgtctacatcataatctccataaaccatgatacgttctttcctgcccatagcttgattaagccgttctacagcaatgctcatatccttcatcaggaatgggtcgtgtagctcgttaagctgggggcggaaaaatcttttagcctctgctgctgaggttatacctctttccagcaacaacttacaaagaatcgggctgatccctgtttctttggctaatgctttagctgcttctgtctgttcttggcttggaggttgataattccatttgtgattcattttatatattgttttttcttttttctgctctcggagacgggataataccattttctggttatacttacccaatcaatccgtaaagttaggaaaaaacaaataaaaaaaccgctaattccatatatattttatggaattagcggtaaagtattgtatagtagcgtattatttgatacctaattttttagcaatttctttaggcagtgcatttttattgactacgatattcatggttttgtaacggacgaatgctttagaggcataccataagccatcgtattttccggcttttccccaagaattctttaccatataatagtcgtttccttcttgatccttagctataccgtaaatcaacataccatgatcatcggttgtttcccaattgtcataagcttcctggcgttcttcttgtgtacaccatttctgaggttgtggtttggtgttcagtttcttttcttccggtttcattttcaaccaatgagccatgtctgatccacttagttcttgtactttttccgtatcgggcataacagctacgccgtcacgtgtaaagccttgttcactgacatcagatccccatgcgattggatagccgttattaatggcattatcaaaaacctgcatgaattcatcaatgggaaggttgtatgattgcccccaacgccagttgtcttgaatttcaagaacaaatggttcgtagaacggatggtgggtgtacgaggtcaatgaaatgtaatcatttggattcaatcctgttgattcgaagaatgaatggggagtgtattcttttcctttataagtgaatttttcagggcatttacctaaatagatatcatgaatagcggcaatggcctttttccataatggattatggttattatctgtctggagtttgcgtaattttcctttggctattgctgctactacagcatccgatacggctgtaagttctgtatggttacttaatgtatcaccatacatgactcccggacgcataacttcttcgggtaccagaccaaattttttcattccatagataacgtcatagaatgatcctccttgggaaaaagatacatctccgtgagtacgtacggcggcatcggctcgatccaaataagtttggtgtacgatgtacatttcagaaaagtcgtattctccttttcccatacgaagtaattctgattctagaaaagccatactggaatagcaccagcaagtaccggcacggctttggttcttgacagaagtaataggcagttcttttactgtagtgaatacaaacccttcttcctttggctcttctttttgtgcatcttgtgcaaagaggcttatactgcataaacctaatgctgctaataatgtaaatcttttcattttagaaataatagttttgtttgttatgttactcattcatgatagtttctacttcttcgatagtgatagggatgcgtttctcgccagtgaaacgggagccttccgaagtaatcagaatatcgtcttccaggcggatgcctccaaaatctttgaatttttcaatggcatcaaagttcaggaagtctgtatgcattttctcagctttccatttgtcaatcaatgctggaataaaatagcagcccggttcatcggtaatcacaaagccttcctgtaagcgacgtcccatgcgcagggaggctagcccgaactgggaagaaggacggatttcatcgtcatatcctacgtaaatttgtcccaggtcttccatgtcatgtacatccaatcccatcatatgacctaatccatggggcaggaataaagcgtgtgcaccagcggcaacagcttcttccacattgcccttcatgagccccaggtcttttaatccttgaaccagcactttgcagacttctaagtgtacagacatataggttatacctggacgagtaatttccaatgctttatcatggcaagccaatacaatattatacacatctttttgccgtccttcaaatttgcctcccacaggtacggtacgggtatggtcagaacaataatttgtcactctttcagctccggcatctgtcagcatcatgcgtcctggttctaatatatggctatggtcatgattatgtaatgtttccccatgttgggtcaggatagtggcaaatgaagtcatgcttccataagaagcggcgatgccatccagtactccggcgatatattgttcctttattccaggtttacatagacgcatagcggctgtgtgcatttcataaccgatattacatgccaaatcgatttctgctatttcgcaagcttcttttacagaacgtaaatcaactacagcttttatcaattctacagaagcgtatttctttactatagcggcacggataccggttaagtcttccaagagcatcatattatcgaatcggtagggaggaaggaaatgtacttttctaccttgtgcgatagcttttcctaccacctcttttagctgggggaagggaaaacttttctgaatacctacttgtgcagccaactctttcacactgggttggggccccatccagataatgtcgtccatatctacatcatttccgaagaaataatcctctcctgcttctatatctattacacctgcatatccggggtgagaatggccgaagaagtagaggaatgaactgtcctgacggaatttatatgtgttatccggatagtttgccggagcttcattattacctagtataaggataataccgttttgcactttgtttctaagtgcctgacggcgtctttgataagttgcggaatcaaacatggctaactttattttaattgaaaatttattgaactgtgttgcaaatgtaataattataatcttaaaagtactatttgcttatttgattttttaatcgatttcggctttatttttatcatttgtcaatcttgcttttctaatttcacaggtttctcttatttttccttgataagttgccattcagtaatttatactgctaggagaatttgattgatatttatgatggaatgcaattatttaataaatataaaagatacggctaaatactttgaaaaggttaactttgcagtgaactctttcaaggatagatttgttcctcaacattgattatgaaaatagatgataaaacagggctggtactggaaggcggaggtatgcgcggagtttttacctgcggggtattagactatatgatggataagaaggtttggtttccgtatggggtaggagtttctgccggagcgtgcaatggtctttcatatatgtctcgccagcgtggtagagctaagtttagtaatattgatttattggagaaatatcattatatcggcataaagcatttatggcgtaagcacagtattcttgatcaggaattgctttatgaacattttcctaaggaaattcttccttatgattataaaacatatgctgaaaatcctgctcgttttgaaatggtgactactaattgcattacaggtagggcgtgttatttggaagagaaacatgatcctcgacgtattattgccatagctaaggcgtccagcagtcttccttatgtttgtcctatagcttatgtagatggtgagccgatgctggatgggggaattgtggattctattcctgtgttgcgtgctattgaacaaggatttgataaaaatgtagtggtacttacccgtaatcggggatatcgcaaaaaaggaaaggatatgaaaattcctcattttatctataaaaaataccctcgtttgcgcgtggttttaagtaaacgttgtcgtatttacaacgaacagcttgatttggtagagcaattggaagacaagggcaggattgtggtaattcgtcctgaaaagccgatggaagtggaccgtattgaaacagatataaagaaactgaccgatttatatgaggaagggtatgcctgtgcaaaaaaaatgttcgaagaaaaacgaatacttcaaaaataaacttttggccaaaagaatgttttttatacatggggatattggaggaatgggggatcattcttgttatatggggtagatgaggttctaccgcatataacaagaatgaatgctctttccttttggaaagaaagataatatattaataatataaatgtgacggtacagttaatacttgctcggtataaacttgctcgacggtcggataatctatagtgaatgtcttttttaaatcctcaaaaaaagccatgaggactatgggggaagtcctggaagaaggtatatattcagagattataaatgttcttttgggttgttctggaagagttagatcaaatgagatgatatgtcttgtaccccattgctcattttctatttcattggattttctttcaaaactaccttctatagccttgtctccaaacttttcttgataaaccagtactttgcctcttgcaatttctgcatccgtgtagataaatttgtatcctcctcctgtctttactggtattgtagctaatgctttttctttaattgtttgtttttcagagtcttttaagtctcctgtaagaagtatatcctgtttgcttacaatgtaattatcggtgtaatagtctactattacatgaatgtcaagtgtgtttcctgattgatctcttacagtaataatcgcttcacctaatgctaatgcttttatggatatgtcgcaagaagaaatcattttggtttctataatttccggtttatcgcagcttatttcataattcccgtctcccccttgcaaaggaaaagagtatgtctgattattaggatagtttaattttatatttgctgtttctctattttttaaggagatgggagcaagttcatcattgctgcacgatgaaattactaaagagcaaaggaaaataagcactgtggctagcatactgttaagtctcatagtttgatcttgttttatgttctacataatttaaatgaaggattagatgatttactgcttggcaattagaaatttatttttttttcttgagtttgtccaggctgtggataaaatgtgggaatacaaaatgaaaaatccctctttcttctaaagaaaaagagggattatagttgagtttcttgtttctgatttttatttggcgaaacttaccgcacgtgtttcgcggatgactgtaatcttcacttgtcccggataagtcatttcgtcttgaatctttttcgcaatttcaccggataaactttcagtctgtttgtcgtcaatcttgtcggcacctacaatcacacgtaattcgcggccagcttggatagcataggtttttgttacccctggataagacatggctaattgttctagatcgttcaaacgcttgatataagcttctacgatttcacggcgagcgcctggacgtgcgcctgaaatggcatcacatacctgtacgatgggagccagcaggctagtcatttcagtttcgtcatggtgagcaccgatagcattacatatgtctggtttctctttatatttttcggctatcttcatgcctaacaatgcgtgcggcaattccggttcttcatcaggtactttacctatatcatgcagtaatccagcacgttttgcttttttaggattcaaacctagttcagaagccatcacagcgcaaagattggctgtttcacgagcatgttgtagaaggttctgaccgtatgaggaccgatatttcatcttaccgataatacggatcaattcagggtgcaggccatgaatacctaaatcaatagtggtacgtttaccggtttcaataatttcttcttctacctgtttgcgtactttagctaccacttcttcaatgcgtgccgggtggatacgtccatctgtaaccagttggtgtaatgctaagcgggcaatttcgcggcgtacagggtcaaacgctgaaagtacaatagcctcgggtgtgtcatctacaacgatttcgacaccggttgctgcttctaaagcccggatattacgcccttcacggccgatgatgcgtccctttatttcgtccgattcaatatggaatacggttacagagttttcgatagcagtttctgtggctactcgttggatagactggataacgatacgtttagcttctttattagctgttaatttggcgtcgtccataatgtcgttaatataggaagcagcctgtgttttcgcttcttctttcaaagattcaatcaggcgttctttggcctcctcagcagaaagaccggaaagagcttccagtttttcacgttcttgcatttgtaatttatccagttcatcctttttcttgtctatgatgacaatttgagcttctagattttctttgatagcttccgcttctgtacgtttgcgttgaacctcttcctgtttttggttcaacatcagttcgcgttgttttaatttattttcggcttgctgaatcttttggttacgtagggcgacttctttttccagatcagcttttttgttcaggaatttttcttttacttccaaaagcttgttctttttaattacttcagcttccgtctgtgcctctttgatgatgatgtcatacttagatttcaggccatatctgaaaagcatgtatgatagtccaccacctacagcgaaacacacaattgctattattaccgttgttatcattgttattaatttatatataaataaaaaacgcacaatctatctgttaagaacccttctcttaacagtatagctgtgcgtgaatatcttcaattctaaacgattactctctgttactgatttgtttttctatctctttggtcagctccttcaatttttcctgataaggtgcagtattattcctgtctttcatagaaatattttcaaaagctaactccagcgcagccattgcccaatgccttgcggggctgaaatcagggtaataactacggtatttgtttagtttattgtcaatctgtttggcagcgtccctgtataactgttcatcttcacgacggatggtcatcgggtatcgttcgttgtcaatcagtagatgtatcttcatcatatcgtccataatactatcgttttattgtccaactttttttattcgtttaataaagcgatgcatttgtcgacctcacgcacaagccttgacaaccgttgttttgtatcattgatgtctttatcatgaatactgattgtcctcgccattttcaaattggtataccttacttctaattctttccggctattttccaatcgtcttacctcctcgtttttttcagtgagaagttgctttaactgtgcattttcatgtttcaattcatcatgcaaatacataaaatgcctcagtcttgcctcgaaagtatttaatagctttttgtcttcttcagtcattttataccaaaattgtacacaaatataaaggattggaagcaaacacgaaaatatttcgtcctaaatttatcgtttgtcgtttaaaaaacttttttaacgtctttattagctgtttttcccgtgctgttcgaatatgatctttttactattacatatgtctgttgaggattgtctatcgttttaatgttttataggacaagatgtgccaggtagtaccgattgcaataatcagaaacaggattcttgcccaaatgtagggtagtgtccagatggcgcaatagcttagggtaatccatattaatgatacggaaatgattttggcatgtaaaggtattgctttatgctcgcggaaattgcggatgtagcttcctaaatatttttgttggatgagccaatgataccagcgtggtgaactgcggaaatacatggcggctgtcagtaataaaaagggggtggtaggcagtaaaggaagaaatatgccgataatgcctagtatgagtgaggttgttcctacaatggtatatagtattttcataggtgcaaatatagaccaaaaaacaaaaaaatacagtgtcctttttatattattcttttttatggtgtatctttgcgtcctgtagcaccgaggtgacattaggtgtgagttctttcttattataattaaatgctatgtatacagtaattaaacgaatggaaatttcagcttcccatagcttgaagctgtcgtatagaagtaaatgtgagaatttgcacggtcacaattggattattaccgtttattgtcgttccgaggttttgaacgaggatggtatggtggtggatttcacgcatatcaaggaaacggtgatggggcgtttggatcaccggaatttgaatgaggttgtttcttttaatcctacagctgaaaatattgcacgctgggtatgtgagcaaattcccacttgtttcaaggttgaagttcgcgagtcagaaggaaataccgttatctatgagaaggattaatgaaatattttacagcttacagggggaggggtatcatactggaatacctgccgtttttgtacgtttttccggatgcaatttgagatgtcctttttgcgatactcagcatgaagaaggtacattgatgagtgatgaggatattgtgatggaagtggcaaaatattcgacccagatagtaatactgactggtggtgagccaggattgtggattgatgaaaagttagttgatgcattgcatcatgaagggaagtatgtttgtattgagacaaacggcacttgtctgctgcctgaaaatatagattgggttacttgttcccctaaagaaggggcgaaaataaatctagatcgtatagatgaggtgaaagtggtttatgtgggacaagatgtttctgcttatttggatttgtctgccagtcattattttttgcagccttgttcttgtgctaatacagaagaagtgattgcttacattttgcaacatccagagtggcggttgagcctacaaactcataaacttttgcaaattccttaagaaagtagaagatataaaaaaagattatccaatggcgtggcattgaataatcttttttgcacgggaggagaggctcgaactcccgacacccggttttggagaccggtgctctaccaactgagctactcccgtgtttgcggctgcaaaggtagtgtaatatttggaatatacaaacctatttatgaaaaaatattgttcattattcgtttaataggcctaactcattgaacatgacctggtatattgctgattttttttcaatgggcaacgggtaggcacggctggacgaaggcattctgtataatcgcattgtccggtcttcgaattcgaaaggttcactggttcctacaacgggttcttttacctttatttgttcacgaataatatccgttgctttttgtcctgtggttacaatggccttgcacattggaatctgcttcagtagcaaactgatatctgtctgttctacaacttccagaaatttgtctgaggcattgtcctgtaaacggcgaacagctgaagcggtatcataaagtgcgatgccttttttgttcaaaagatcaataatacgttccttgtcaaatacctttttgtcaggattcagaaagtggtctttgttttggaaaaatattattccaaaaatacgccacatatcattttgcagattgggataaaagaattccatgctccatcgtttcttttgtgggggaaaactgcctaacatcagtagtttggcgttaaccggtaaaaaaggctctaatggatgttcttctatatttaataaggatttcataaaatctttaatgattattcttttggctttggttcttttttagccagtaatacaatgttatacacatattccgtcatccagttttcagaatatcctaaggcttgtttgtatttacggatggcaacacaggtcttgtgtacgctttcgtctttccagtcggtcttggtcatgatatcatgaattgttttctcggtcatgttacgtaacatttttttcattacgctgggcatacggaatttccattgcatcaaattacctatcagcatcatcaagtcattgctgaatccttggaacataaaaagataagtcttgacatcatttacattcttgcaattcttttttatagaaccgtcaatttctttaaagaaatcatcacttagcccataaagttctactaacatctttttgcagcgtgacttctcagcaattcccaacttgttgttttgggtcggtattttaagggtgcgtttgaaaactgccatgtctggcaaaaaattaatatttgtgatacctatgttgcaggccattacagactgataatatacacggattagtgtcatgaagtcttccataccacctatgcggcttgtttcttctccttctgtctgttttttaccaaataattttgaaaatatgctcattgtgttcttaaattatattgttttcctgtctgcaaagatagcgataaaaactgaaacatttttgattaaaatccttttgttttactatttatcatttttattgaatggttgatgccgggggtattgctttgtgttaccagcattccaaatcattttcaatatctttcattctgtctttggtgaaaactggatttttgaccccgttacgtttctgaattcgatagtcttccaatagacggaatgcatatttccctagtaaagtaatggctatcaagttacagatagtcataaatcccattgccatatcggccaggctccatgccagttccagactggccaatgccccaaacataaccattcctcccactgctatacgataaatggggatagcccatttccgatgagttatgtaacgtacattggcttcaccgtaataataatttcccaaaatgctgctataggcgaaaaacagaattgccaccgccacataaatagttccgatgttgcctatttcattattcagtgccatttgagtaagttttattccattggcttcttttgtggaggccactccgctgaaaagaatgatgaaagcagtgcaggtacatatgacaagtgtatcggtaaaaactcccaatgtctgaattaatccttgttttacaggatgggtaacatcggcacttgccgctacattgggtgcggaacccataccggcctcattgctgaataatccacgtttgattccttgcattaatgccatgcctatacctccgcttaatgcctgttcccagccaaaggcattcgctataatcaattcaataacttctggcaaatgctttgcatttacaattacgatgaaaagggataaaaagatgtatcccaatgccatgacaggaacaataatgctacttactttagcaatacgctgaatgcctccgaagatgataattaatgtgagcgaggtcagtatcactcccattaggctgggaggaatattgaatgcttcttcgaaagcggcacaaatggtattgctttgtactgaattaaaagcaaatccaaaagtaaagataagcaaaaaggcaaacaaaactcccatccacggctgttttaatccttttttcatgtaataagctggcccgccaacgaaagaattatgtccgtgtactttatataattgggccaatgtggactcaataaaagcgctgctggccccaaaaagagcaattacccacatccagaaaactgcacccggaccacccaaagtaatggcggtggcgactcctgccaaattgcctgttcctacgcggctagctatggaaacggcaaaagcttgaaaagaggaaatatggtgttcgcgaccttctgtcttgcctgtagaatcacctaatagacgtatcatttctcttatcatgcggaattgtacgaaatttgttttaaaagtaaaccaaaatgcacatcctaacagcatgatgatcaaaatataagtccaaagcacatcattcactctgctgattaatagggtcagtatatccattttacttattccttgtttaatttaaaatagaacttatgtccatggaaaacaagttccactagaccaaaacggataaagtctgctaatagttcacaagttgtcttgtggtttaacctgcaaagtttgcaacattgatttaatgaaagtttttctttttctttcaagacatccagtaaccgttgctctctttcggtaaatgttacaagtgctccttcaggtttcttgctgtgttgccacatctttagatggacgggagtggccagtatgttttcgtctttgatgcggatataggcccatggcttattcgtttcatctagggcatatacaggtttagaaaccgtttcgttaatacgtatttccaatacagtctttccttctaccttgtaagtctgcgtttccagttctactttgggcttgcaatacatggttgctgctgcttctatcatatatatttcttcgtcagagcggactcctgctattttgccattgtcctttactcctattaacagcctgccgccctcggtattggcgaatgcggaaaggctacgggctattttgcgtgcgtccgaaatctcgaatttgaaatcctgatgacagtgttctccctccgagacaagctgtcgtatgtattgtgtatccgttaatgctttcatttcaattgcaaaaataggaaaaatgaaacatattgtgggtatcgaatgataaaaaagccgatattagtttgtctgttatcaagctttttgcttcatttgcagtggaataaaaataattagcctttaaaatctatgggaataagaaaaaaatgtttgatcattacattattatgcttttctagtctgatgcatgcaagtgaattcatgtttaaacatttggaggtgaaagatggtctgtcaaacaatcaagtccttgatatatttaaagattccgaaggttttatgtggtttgccacagcttccggtttaaatcggtatgacgggtgccagatgactttgtttcgtagtaataatgctgatccggcttctttacctgataattatatcaaaagcatacaagaagattataaaggaaatttatggattcttaccggtgtgggttatgtcatttacaactcggaatcagaaacatttgatagggaggtgcatgcatggctatgtgaagtcggtattgacggaactccagcattagtatatatagaccataataaaaatatgtggttttatataaaaggaaaaggctgttatttgtacattccggaatctcaattactgtatccgcttttgtttaatactcatcagttgccagaaggtgatattacggacattgtagaatgtagcaagggaatcttgttggtatataataccggaagacttgtttgtttggatactcggacaaatgagattaaatggcagcaggatgatttggttggggaattgggaactgacaagcagggaattttcactctgtttgtagatcgtgataatgatatatggatgtacagtccgcttggaatatgggtttataatccggaacaggaaaagtggctgtcttggctgacaaatattatcaagcgtcggtctcataacatggtccgtgctgtatcacaggataagcaagggcgtatatggataggaacagatcaggatggcattgatatattggataagaagacaggggaagtgaggcagttgcggaacaaggcaggtgatgaacgtagtttgcaaaataatacagtaatggttctatacgaggattccagtgaaactatgtgggtggggacttataaaaaaggaatttcctattttaatgagtgtgcttttaaatttggtgcagagtatataggagatattagttgcattgaagaagacaaagaggggtatgtgtggctgggtaccaacgatgtcggtatcatatattggaattccgtgactggcaaccgggctgcttttccacagaaaggtacggataaactcactactgatgctattgtttgcattttgaaagccggtgatgggaaactttggattggtacttttgggggaggcttgatttgttatgataacggtcgtattattcattataaaaaaaacataccggaacggcaaaattctttggctcataataatgtattggctttggctgaagataagcaggggattatatggataggtacattgggtgggggagtgcagagtttgaatcccaagacgggtttgttcaccacttataatacaacttcggccggtttgatatccgattatgtttcctctttgtgtatgggaaaagagggctctttgtggattggtaccgctcagggactttcggaattggatattgaaactaaaaaagtggttaatctggaaggtactaaatctggtaaggaatatttttctgatcagaatataagtcaggtgtatgaggatagccgtggattgatatggattggtacatgtgaggggctgaatgtttataatcccaaaacggatgaactgattatattaggagtggagcaaggagtgtccagccctatcatttctggaatagtagaagatggtaatgaaaatatatgggtgactacagcacgtggaataactaatgtcataccggcagtagatttaaaaacagggcgctatatttttcatagttgtgtttatgatgacaaagatggtttgcaaaatagtgggttcaacctgcgttccattaaaaaattgtcttctggagaaattcttatgggagggctgtatggtattaaccgcttccgtccggatgatataaaatacaataaaaaacgtcccagcgtgatgtttacccgtttgttcttgttcaatgaagaagtaggggtgggtgaggaatatgaaggcagggtgattttggataaggcgttgaacaaggtagatcagataaaattgagttatgaacagaatatgttcagtgtacaatttgcttctgataactatattttgccggaaaaaacggagtatgcttataaactggaaggtttcaatgaaggttggatgactactgcctttggcaaagtgacttatactaatctagctcccggaatttatatgctgaaggtgaaagcagtcaacagtgacggatatggtggagatgaagaagcttcattgaaaattgttatctatcctcctttttggagttccgtttgggcatatgttgtttatagccttttgttggttgctgtattgatattgggacgctattggattctgcgtggagaacgggataaatttaaaaaacagcaaataaagcaagaaatagagaggaatcaggagaaggcagatatgaaattgaagttcttcactcatgtcggccacgaattacgtacttcgctcactcttattatctcaccgttggaaacgctgatgaaggaatatcaatcggatgctgctctgatggataaattaaatatagtgcaacgcaatgcattaaggttgttgaatcttgtaaatcagttgttggattttaggaaaattgatgtgaatggatattatttaagtctgtctgatgatgatatcatctcttgtattcatacgatttgtgattcttttatctctttgtctgaaaagaaagatatttctctcatttttcattcagcagttccttcgttgaatatgttgtttgatggggataaaatgagggaagtgatgatgaatctgctttccaatgctttaaaatttacttgcaatggtggacgagttgatgtgtctgtcggtttagtggaaggacaggattctcgggaaatgctggaaatcagagtggctgatacaggtgtcggcattaaagaagaaaacagagaacgcattttcgaacgtttttatcaagtggataatccggatatgaatatctcagatggcggaggtggtctgagtattgtacgtgattttgtcacacttcacgatggcacggtgaacgtaatggataatactcctgtcggttgtgtttttgttatccatatcccggtaaagcgttccgagagtaaaccgacgaagatagaacaggtgcaagttacagataagccggtagaagacatttccacacttcagattccggagttttatatggcgtctaatgccggggaggaatcggaagaagaaccaaaccatataataacaatagaaggactggaggaggatatccgaagattagaatctggtaatacggaagaaattgcagaagaaaaaaacatagaaacaatctcagccgttgctccacaaagagcaacggtgattcaattgattgagggtgaggataatgagatgataactcatattattccaccggaggagttgccggaaatggtgactgctgttcctgaagaaaaaagtgaacagaagttgaaaacggtttggaatcatgcttatattgatttcaaacctagtgggactgccataacttcgatggatgaaaaactgataaatcatgctgtgaaatatgtagaagacaatattgcacgcagtgatttgtctgtagaagagttaagcaaggaattagggatgagccgcgttcatttatataaaaagttattggctattaccggtaagactcctatcgagtttattcgtataattcgtttacagcgggctgcccaattactccgtggaagtcaacagaatatttcagaaatagcctatcaggtgggctttaataatccgaaatatttcagtcggtattttaaggaagaatttggtatactaccttcggcttttcaatatagacaaggcagatagttctcaatattttatagtgtcatttaaagtgtgtatcggagtttcgtcaacagacatacgttctgtaacagatttcatctatgagtaaaaacaattccattttattattgtttttattagtaatagttatacattaaaaccaatatagaatggaacatacagttatacatgacgagaaagtagaccgtttcgaagtatttgaatcgggacaaatcgcctatttgcaatatgatgaaaagaacggagttttggatatccttcataccatagttcccccacagttggaagggcagggaatagctcaggctttgaccgaggccgctgtgagatatgcttcggttgtagggcttaaaatacgtcctacttgttcttttgcaaaaatgttttttacccggcatacccaatataaagacatgttggtggagtgagaaataaaatcagacacggattgtataaaatgccgtgtctgattcgtttttaactctcttatctttatatatatttaatcacattgtttgtgggtcataatatccaatactagtttatcggtttcattcatgccttgtgaaccaattctggtcaggttgcggatgctgcggtccacatcattgtcaatgataccttctacagaagatacacatttatgttccatcgctaatatagctgaaaatacagcagtagaaacaccgctgcttaatttcagagcacaactgggcttggctccgtcacaaatcatacctgtcaggttagcgatcatattttgtacggcaaaagtgatttgctcgtaagtgcctcccatcaaataagtgataccacagctggaacctgttgcagccactacacagccgcatagtgcagacagacgtcccaagctttgtttgatgtaaatcgctgtcaggtggctaagtgtcagtgcgcggatcaattcttcttctgatttatggttgtcttcggcatagactactaccggtaaagtagctgtaattccttggttcccacttcctgaattgctcatgacaggaatcatagctcccgccatacgtgcatcgcaagctgccgaggtataagaaaggatgtgggtaaatgtattacttcccaatatttgttcttcgcttttgctgcttttcagaatcttgcctaattcgtgaccgtagtttcctttgaaagaacgttctgccgctgctttgttcaaacgtttggtctcaagaataaaacgaatttcatccaatggtgtggtggtggcaaaatcgtacactttccgcaagttcaactccggctcttttgcatcctcattgcaggtggaggtagtttgtttgtttagtaaaacttggttgtttagggccacatatataaaattggtatgcccgcaagcaataatggccgtcgctgtatcaccatcagcttcacagataatttcgatatataacttttcttctatattctctttcagcccgatagagatagcttgtgagtcaattagttttttaccctctgctacggcgtcaggagtgctgtcttttaagacttccaattgatattcggattttccgattaatgcccctaaggcgatagcgataggtagcccaatcattcctgttcccgggatgcctactcccatggcgttcttaagaatattggcgctgagtaaagctttaatcctttcaggtcttttacctagtgtttctgttgcttttgctacacaaagggctacggctatgggttctgtgcacccgatagccggaacgacctcgcgatttataagggcaatgatttgctctctttctggtttggcgatcatagtagataattattaaggggtcttgcaaaaatctttttgaaagtgtgtcaaaactcggataaaactatcgtttcgtttgtcttttcctttttgttgattttcagaatatgctttaatgaagaaatattctgaatgaataaaatgataggtttatttagttttgacactccttcgacttttgacacactttggttattttttatagttttgtaatccggtctggaggaaatcaacatatttgtctatatcctcatcatatgaatatgatttattcaacggttttccctcattgtcaatcaatacatagaaaggttgtgcattggcaccgaatttagagcgttgcaggtaactccatttatcaccgatcgtgcgtagtgtacgttccttaccgttctccatcactttgatgtgttcgggcaatggggttttgttatcaacgaacaatgtaatcagtacatagtcctcagtcatcaacttgtttactttcggatcagtccatacagcagcttccattttacggcaatttacacatccgtaacctgtaaagtcaagcattaccggttttccggtacgttttgcatattccataccggcatcgtagtcatcaaactgcgcatgtacttcattggtgtataagttgaagtcttgtgtattcatgggaggagcaaatgcgctgacagctttcaaaggagcaccccataagcccggtaccatatatacagcaaatgcaagtgagataagagccataaaaaaacgggcaacacctactttatcatcatcatcatcgtgagggaatttgatcttacccagcaaatagaagcctagcaaagcgaaaatcacaatccacaaagcaaggaatgtttcacggtctagaattccccatccataagccaagtcagcaaccgacaggaatttcaaagcaaatgcgagctcaaggaaacctaatactactttaattacattcatccaaccaccggatttaggcatggatttcagccaagacgggaacatggcaaacagtgtgaatggcaacgctaatgcaagagcaaaacctaacatgccgatagcaggggcaactacactacctgtagtggaaacttctaccaacaaaaagccgatgataggacctgtgcatgagaatgaaaccaaagatagggtgaatgccatcaggaagatacttaacaaaccactggtctgttccgctttactgtctactgcattgctccattttgaaggaagagtaagttcgaatgctccaaagaaagaggctgcaaacacaattagcatcaagcagaagaatatgttaaaaatagcatttgtggaaagtgcattcaaggcactggcaccgaatatcaaggttatggcaagacctaataatacatagatcactacgatagaagcaccatatgtccatgcatcacggattcctttctttttgtctttgctacgttttaaaaagaaacttaccgtcattgggatgataggccatacacagggcgtaaataaggcaagtaatccaccgataaacccggcaaagaagatgtaaatccatgaacggtcttgttgtgatgtcgtttcgccaaatgcgttcagctcttggataaccggagtccaataatcttggacagcagtgtcattgccgatcagggcggcagttgtagcactatctgttgcggtagttgcagtagctgtttccgctacaggaacttccgttatggctgtttctgtttttgcgggttcagtagtcttgcttgtagtggcagcggcaactccttttccggagaaagagaaagaaacttcagtaggaggcagacagttttcatcgttgcaggcaccgaattccatataaccttctatcatataggtagcacccgttatttttagtttctgaatgaaaatggcagtgttctcaaagtaacgtaatttcatttcaaacaccttgtcgaagttttcaatttctttaccttgtggagtgagctttcctactaattctactccttctatcttgtctacgttgaaagtagcggagataggacctcccgaaggaagatcagtggaataaacgtgccatccggcatcaatcttaccagtgaatactatttgtgcttccgtatcggaaatcgtctttaactcggttttgaattgtaccggatcttgaatctgggcaactgccggaagcaatgccataacgattaagaggcaacttaaaaaaaacttctttttcattacgtattatttaaatttggattaatgttcataccgcaaagtaagggataatatcttagatatgcctctttatacctatattaatatcggcaattgctgttttcagaataaaaaaaagagcaaaaagataacctattgctctttttgaagttccataactttgttcctatattgggagggagtcattcccactgaggattggaaaaggttataaaaggtggaaatggagttaaatcccagctctgtagaaatggctttcagcggagtttcgttattggggtcggataatagacggatagcttcttcaatacggaaacggtttacataatgagtgaaggatagtttggattgttcattgatgatacgtgatagataagtacggttagttcctaatatttctgctactttgtcttttgttataaaattgtctttgtaaattttttcttctctcataatacgctctaatgtacggaaaagttctaaacttttctcgtcggtgagtgaggaggaagcatatttttcggaagtagaaaccatggagggggcattggtttccaattcttttatacggcgattcagttccgtttctcttttgattgcttcttgattttgcttgactatacttaaataaagtttgtttttacggtggtagaggtaataaagcaatcctagaacaatcacaatgataataagaataaatgtctgttgttgtatacgctgttctttctgcattacatccagtttgctttgttttatcaaattttcctgccgctcagagtcgtatttgaatcgcatttcacttaaatctctttctttgtccttgttgaaaagactgtcgttttccaaacggaatattttataatatttcagtgcgtcatgatattggtgcaattgctcatagcaggtggacagattttcgtatagttcattgcgatggatggcgttgacgcgtgcataagaaatagctattccttgttttaacaataaaatagcttctggttgtttgttttgctgcattagtatacgtgcatatcccaaatgggcatagacaatagaggaagtttgtgccgcctgtttgtccttcatggcttttttgtaatattccaaggcctgggcatattcacccatatcatataatatattgccaaagagattgtaggtatgggcttggtcgtagaaatcattttccagcatcaatgtttcggcttcatgtatatatttcattgcttcctcattctgtttcattaaaaaatacatataggcagaatttactgcaccggaataaatgatgtatggattacgcatactgtgtcctaattcataacattctaatgcgtatttgataccggctgtatcttttttgaggtaatagatgtttgctaaattgcctaaaagcaaagcgtattgttgttggaaattattttgttgtgccaattggatacctttataaagccatcgtatggcacggtaataatcggtttcaatatttgcagagtagagtccgagactaccatagacggaacaaagggtggagtcattattcagtttggttgctagttcaagagaaaggttcaagttttttttggctattttttcccgtccgctcatcatttgtgcttgtgcttggtagatatatgaatagagttggagtagaggatttttagtcttgtccgctacgtttttcataatctcggcgtaagtgatggttttggaataatctcctttatttaaatagtattggcatagaaactttaatgcatccccgttatcaggttctttcctaatgatctccaactgtttctcaaggatgacggggcgcttttgtgcatgtacacaaaaggatattcccaaaagtaacagtaagaaaagacattttagtttcatatgctttttttcggttgagagtgcaaatataataaaacctttaatttttcttgttcaaaagtcttgcatatttaaaataaagtcgtacctttgcaacgctttcaacaaaaagcacttctgaaaggaagttttggagaggtggcagagtggtcgattgcggcggtcttgaaaaccgttgtaccgcgaggtacccggggttcgaatccctgtctctccgctggaaagaattgcaaaacaaagaaaatccctgtaaattaatactttacggggatttttttgtttttggtgcatggcaaaaataagcatatcaaagcattctttcggtgtactattcggtgtacctggtcttatgcttacatatgtgatatcctcatgctctcaaaaaagatcaagaacttttcaaaaaagacgacgacgtttttaaaaaagaacaggaacttttttaaaaacgtcttggtcttttttattgttaccaatgcatcgtaaaccgtcattctgtggaggtacagacctttcatgcgtactttttgcggggaaaaagcctaaaacaccctactttatatcaagtcgaaacgatctataagaaaatggtatgtggctgaaaacaagtaatttatgtggaaatatacttcaaaacattgtgagagtatgagagcatgaatgagagcaattttttttatccttactacataaaccgttaataataaacctgttatatatgcagtgagggcatgagggtatacatggctcgaacttttctttggaatatgcaaaacggctatattccacgatataggaatatatgccgttttgatagaggggaaattttttatggtatataattccaataatccatatttgtaatgatttgaactataattttacgatctccttctcgtatttcgttgggagcattctgagatgcatacgatatttttgcgcccactccttttgcttttaacattttattgggaactcctttctttataagtgcattgactacagcgtctgcacgtttttgggatagatccatattgtattgtgatgatccttttgcatcagtacatcctgtgatgagatattttttgcttgtgtctgtcagcataatttgagctatttcatcaatgatagtagctgctttaggagttatttctgttttatcaaactcaaaatagatattgttgaataaatcacataaaacattggtctggcttggagtttctacaatttgtttcatgattataggtttttctataactttttctatgattttttccacatattgaatttccggtttgacttttagggatttaccaccaatgcgccacatcaatcgaatgcttccttgccatgaattggctatatgtttgtatggcatgatgaggtagtctccttggagtcctatgccaatgttgtcattaagccacatattcacgcctattcccaatgaaatagggataagattttgtttatctttcccttctttagtataatcatttgatagattccatcccatctcctcactgttgaattcttccatccccttatagttgatcttaaaattcttgtacatatagttggctcccatccgtaggaaaggatcaatataatttgaatggagatattcacctagacgccactgtaaaccgattcctgccatacctagccatcttgattctttaccgttacggacaggatcggaactgtagtctaatgttccttgtaaatctagataaaaatgagagttaagttcacgagcaaaatatagatttcctccaaaaataaaatcttttttattagtacctacagtgtaaccgcctttattattagtatggaaattaatgacattaaaacgtgtcatttgaagtccggttgcgcctatacctatttcccatgcttttttattattatcggctgctccattctttgcattttgttgtgcatttataggtaaaccgaaacataatactgaggtaaagcatagtatgagatggattttatgtatatatattttcttcatatttttattcttcatagataacttgtacttcgggcaactcataagagctgctatagttttcaataataaatgttttttcatcctttccttttcggagataaccttgataatatctatagaaatatgaactgttgccactgtcaatgtatatggatgaatttaaaaatggtgcgaatactttgaacgttggaacttctgcagaagatctgttattagaacttgatgcttcttgtgagccggctgttgaggtatatctgaatgtgatatatgccattttaagtttgctggcttcttcttcagtatatgctatcggttctacatagtccattccattttctttaacaacacgtgtggtcgatgatttgtaaattcttgtaaagtctatttttgaaaaatccaattcaccttcagcagatgagaaactgggtgcttctccattggatattatttttaattttaatgtttttagcgtaggtcccatttgataaggagctaataaacaaacaccattccattggaaagtttctccataataaggttctctagcttttacagtgtaataaacgtcacttccatcccaatattcagattgattgtttttgaattttccgggattttcttgaatgaaccgataggtataaatatagtaataatatcctccattatttgaactagagccttggcttgaatatagttttttatctgacaaaatactgttgggattatttttgtcagagactctatatgcgtctaaattccttgaaccactattaggtaaataagaagggatattttgccattggtcttccggattaacttttcgttgtatatagaaatatagatactgataatcgtataatgaatttgaattatcgcggaggatcattctcatgcgtactctattaggaacatatgtgtttttagcggattcttgcggcaactttccggctagggttacttcttttaccgttccccagcgtaagtttatgtcttgtatttcgggtaaatcttctttaggtacaataaactctccgttttcattggtaatgtaagttttttccgcattgatacccggcatgccttttacttgagcttttggtgcgatttgtccagtttcatcatatactttatagagtacacctccatcagttgtgcgtacatattcaccatattctgattgagaatattgtgcaataacattaggtatacccttaatgatggtaacttctgttcccggttttcctggttctccgggtttgccgtctttgccatcttctccgtctttgccatctttcccgtgtagatagtcataaaaatcctttaacgtatttttttcacagtcccatactccaccatttttgtggtcaataagtgcatctgttgtaccgcaaaatttagctaagtcatttttccacagttcatgtgctgataaaccattgcttccgtttattccgtctttaccagctaaataattgaaaaaatcatattctgaaactttgtcagaaggccatttttgtcctggatttttaggatcattcatattgcctgttcctacagtttctttccatagttcataagcggattttccattgttaccatttgttccactgaggtaagtgtaaaaatctgccattgtaattttatctttggaccatgctgaattatttttgtctttgattttatcatttttgacgtcatttacccataattcgtatgcagatgctccgttaactcctttttctccttgagcttttattcttgtatcagtagtacctatccaccaatttccgttattacctatatggggagatacgccatcatctcctttctctccttgagcttttattcctgtatcggtggtgcctatccaccagttcccattttttatcaccggggtaagtccgtccgctcctttatcaccttgttctcctttgggaccttgcactgcaatccctgtattggatgtgcctatccaccagtatccgtctttaatgaaaggggttaatccatcgcttcctttttctccttgagcttttatttttgtatcggatgtattgatccaccagtttccattaggaccaatataaggggatgttccgtctttaccattttctcctttttgaccttgagccggaaaatttgtatcacgattgccaatataccaattaccattttcaccaacatgtggagtaataccattttcaccatctttcccttttaaatataaaaagaaatgttccattgttgtttggtctttgggccaatttatattgccgccagcaacagattgtttccataattcataggcggaaaatccgtctttgccattaattccatcctttccatctttgccgatagctttgatttttgtatctttattgccgatataccaattcccattttcgccaatatgaggtgattctccgtctcttccgctaagaaaatcccaaaaatcggcttctgtattttttgaagaaggccaaatgagcgaagggtcatgagggttggtgacattaccttgggtgatcaggattttccattgatcgtatgcagacattccatcttttcctttgtctcctttttctcctttaatataaactaaaaagtctgctaaatcaacttgggtggaaggccagtttatatgaccggtttcaacttcttctttccatatctcataagcggatttgccattggttccctgaggaccttggggtaattcaaaatcaatactgctgcacgagaaaaaaaatgtgcaaagtagcactgataatacataaattttgcatttcttctttgtatacatgactgtaaattattaaaaatgaattgttctttgttgttacatattggataaactccgttctgctttattgaatattgtatcgttggggggcatgcaattttatattttaggttattctgctgtgtgcgatttacattataataatattcacattttatttgggtgcaaagttctatatttggtactaaaaagaagttgcgtatttaaaagatttgtttgcatataatcagttctttcttttatatctgcataaaaaggtttcctatttttctaaatgttcgttttgggatagttttaaatggtagatgctttatatgattttacagaggggtatatgtgataagttttccatatattgatggtggattatgattaggttttgtgatatttgttattatagatgtatagaaactcttaaaatagatccatataccgagatcaggaaacaaacttattattagctttagtgtgtatgatggagataactatattcataatctttaggatgcgggatgtttgtttaatcgtttgcagaaactgaatatgtttcaagagaaggtgtatctcttgattcttctccttttttacgtatttcgttaggagtagctccgatatttcttttacagtaggttgtaaaatgggagaaagtcttgaaatgatagtccagcattatttgtttgatgggtaaagtacttttttttaatttgaattcaatttcataagatgtttgtttttgtaaccattgatatggtgtatctccatggaagttttttttgaataactgtgtgaaaacagtatcattatatccacataaaacagctagttctttggctgttctgcaagctttgtaatgtgtcatgacggatacgaagaattgaaggtcgttagatagcgcatcacggaaaatggaggcaatttcattcttcttatagcaaattttaaataatgagaacaattcatattctttggctcgatgtaagtcgggaatttctgttccatttttcatgtaatcgaccagcaaatctaagtaggaacgcattaacggataaatgggaaggacttctaccggttttacttcttcgatggatatatcttgcagatactctattgttctgctatgtagataaggagccacaatattacatgcatgaatgacaagttgtacttcatccattgccttgattttacattgatgcaggctgctgatgaagaaaaattcattctgcattgccatcagaggcatggattctatatgatctctgaataggcataatgatccttttagaacaaaacaaacttgaaattcatgggtttcgttcaagttttggataatctctcctttacttatatgaagacacctgaattggctgaatctggatagcgcaagaggatcacggtataaattctttagtaaaaatagcatttccatacattataaacattttaagataaaaaaagttttgatacatctatcccggacaaatataacttgatatttaaaatgttttaaagctataggaggaatatgcaactaaatcattgctaatatgaaattgaatcttctgtttaagaaagagtttatcaacatatgaaattataaggtatttaaggccggatgctttggatggtagcttataaagtggaagatgtttgctgattttttttatgagtgaatgtaaataagtgatttggaatggagataaatctaaggatctttttcttattgcaatgaacaataaggaaattacaaataaaaatccgaatataaggccgctcatgtgatactgattactaagtatcgattatataagtattccccatcttcgggagtatggttcaaagtacaaagcaaccattggcataatggattatttgtgtcgtgggaacaatagaagtaaataaggaatgacggactacctataagtagggtaagtactgtcagaatctctattgttctatgatgaagtgtcttgttcacaggcatttcatgatgtgtcaatttaatcatgcttgctttttttacaaaattggttatagaaatacatactgataatacctattaatggtgataattttcggctttatacctaaaaataagtactcgtgtattttatgatgtatatgattatcagtaataaaaccccaatttttaggtattgtgtactcttggtggcaagggtaactttgcaacaaatttgaaaacataaaataataactattaatcaataaaactaaagtattatgaaattgaaaaactttttagcgatgatggctattgcattgtgtgcagtagcatgtagtgacaatgatgataaaaaggaagataccgtgattccggctcaggaggttgctggtatttacaatggaacattatcactctcagtatcaggaaatgatcaaggaacgtcagacagtcaggtgaaaattactgcggaagaagggggaactgttcaagttcttctagttggcggtgctggtgaaggaatgatgtcattgccggatattgctatacctggaattaaagtgcatacctccgataatgtcacttatattttgccggaaagtgctgttgatgtaactgttggttctgtaaaatatacaggaagtttacaaggaacgattaaggatgaaaaggctgatctgatctttacactaaagccgggagccatgcctatggctattactgcgacttttgtaggcactaaatagcatgaaaagatatctctctattataaccatactgggaatgatgcttttgccattctcggcatgtgatggtattttggaaggaatatatgatagtcctgctgcttcggatagtaatgaattgggttttataagaacagacccttctacccattcgggtactatttatattgatgctactgattatagacgttggacttttatcgatttccatacacaaaaagtagattctgtaaatgtgacggattctgaacagaaagaaccggaggaatgggatattgctgttcatcgttatgatgttaaaaccaatgctggagcagtattggaaaccggtttcacaggtttttctgctttacggaatgcggatgcgatgcccgaaggagcctatgtggaggatgtttggactaccgctaagatagccattgatatgtcaggtatgatggatggtaatattgtttatatggaatcctattataatgaagaactatccaaatggttgaatgttgataaaagtaatatgccacctacctatactctttcaaacaaggtttatatggtaaagctgaaagatggaacttatgcggctgttcgtctcacaaattatatgaatgctagtggtgtaaaaggcttcatgactattgattatatttatccgtttgaattgtaaaccgacatacgatatgcatagactactcagaaacgtgtgcttgatactgtgttggctgatggcggtatcagtatcagcacaacgaattatttcgggaactgtatttgatgaaaataaagaacctctgacgggagcaacagtttccgtaaaagaaaaagtaactttgggaaccactacggatacacagggaaaatacatgttgaaattacccgataatagagaatatactctacaggtttcatacatggggtatatctcgcagactcataaagtgtctgtcagtaaaacaggtaaagttgattttatactgaaagaagatgctgtaaatatggaaactgtagttgtaacgggaacccgtactccgaaactcctgaaagatgttcccattgtaactcgtgtcattactgccgatgaaataaaaaaagtagatgctacccatattggagatttacttcaggcagaactgccgggaattgaattctcttattccatggaccagcaagtttctctcaatatgcaaggatttggtggaaatgctgtactttttctggttgatggtgagcgtctggcaggtgagactttggataatatagactacaaccgattgaatatgagcaatgtggagcgtattgaaattgtaaaaggtgcggcttcttcactctatggttcgaatgcggtaggaggagtggtaaacatcataagtaaagtgcctgcggagccttggactgtgaatctcaatggacgttacggggcttataatgagcagcgttatggaggaacaataggtttcaatgttggaaaattcaatagtgtgactaatgtacagcatacccaagtagatgaaaaagatttggcagatggaaaaacaaatgaggaaacggaggattgggcatttaaaaaggtgtatggtgataaaacttggaatttcaaagaacgtttggtctatactgctaatgaccatctgaaactgacggcacgtgccggatatttttttcgtgaacgtgagaagtcacagactagtaaagaccgttatcgagacttcagtggtggggtgaaaggaaattatgtattggataaagataaggatctggaaatagcttattctttcgaccagtatgataagagcgactacttgccgcaagatgctaatgatgtacgtgattatagtaatgtacaacattcggttcatactttttataatcatacttttgtcggtaagcatattctcaccgtgggtggtgattatatgcgtgattatttaatgtcctatcagtttgccaataatggaagtaaacatcagtatacagtggacggctttgcacagtttgactggaacccgacgaaatatttcaatgtcatcacaggattacgttttgattattattcagattccgatattaatcatttctctcccaaattaggactgatgtataaaataggaaactgttcattgagaggttcctatgctggtggtttccgagctcctactttgaaagaaatgtatatgaattttgatatggcaagtatttttatgatttatggtaatcctgacttgaagcctgaaaccagccataatttttctctttcggcagaatatatgaaaggtcgttataatttgacggtgacaggtttctataatgtagttgataatcgtatcactacggcgtggagtgaggcgttgaaagggcaggtatataccaatatatcaaatatcaggatatccggtgccgaggcaaatgcttccgtcaaatatccttgtggactgtcggcacgtttatcttacgcctatacacacgagaatataaagaaagggcaacctgtcatttcaagtactcgcccgcatacggctactgtccgtcttgagtatgacaagcattggaagaactatgcgtttaatgttgctttgaacggacgctttctgtccaaggtgaatacggaggaatatacttcgaacacttcttatgaagaaactgagaaggtgacctatccggcgtatacaatgtggaagcttacgttgtctcagaaagtatggaaaggtgttgatatgactttggcggtagacaacctgtttaattatgtccctttccgttattataataattcgcctgctactaaaggaacaactttttcagccggtttgtcattggatatagaacaattgttcaaatgaaatttggctgctaatactaaataaactatgtgatttaaataaagatatgaagaagaaacaattattgattggcggagggatagcagtcatcttgctgcttttgtttggtgtatggaatctttggttcagtgcaactaaagtggctttcatcaactatcaggtaatcagtttagggcagatatctaaagctaatgacaactcatttattaaaatcagtgaactgagcacagatgatctgaaccgattggccggttatgatatggtatttatcaatgccatgggattaaggattactgaagagcaacgtgcgcaaatacaaaaggcagccgatggtggtctgccggtattgactactgccgctaccaatcctgcaaacaagattatttcattggattccatccaagcggatatattgaaacattatctgtctaatggaggacgtcgtaactatcgcagtatgctgaattatgtgcgtgtgcatattgataaaaaactattctctgtgtctgaaccggaagccgtaatgaaacgtgccgatgatgtgctttatcacatggatccaaagaaacccgaagacgaagagttgggtttcaatacggtagccggatacaatacttttctgcaacataacggcttgtggaaagagaatgctccgcgtattattgtgaccggtccgatgggtgaaccttccgggcttattgctaaattggaggaaactggcaatatggtttatcctatacgttccatgcgttcttttattcagaaccatggaattgattctgtccgtccgtctgctattatcaatatggcgcatggacgtatgggtgaacctattgtagattatctggcgaaacagaatataccgcttttctctccattgaatgtaaatcgcttggtagaggagtgggagagggacaagatggggatgaatggcggctttatgtcacaaagtattgttactcccgagatagatggagctatccgtccgttcgctctttttggacattataaggatgaggagggtttgcaacacgcttatgctattccagaacgcttggaaacttttgtagaaacagttaataactatattgctctgcagcgtaaacccaatagtgagaaacgcgttgctatttattattataaaggtcctggtcagaatgcactgactgcgggtagtatggaagtggttccttcactttataacttgttgcagcgtatgaaacgcgagggctacaaggtggacggtttgcctacctcttcgaaagaattggaacagatgatacaatctcaaggagccgtatttggttcgtatgccgaaggagcttttgatcggtttatggaaaccggcaagcccgaactcataacaaaagaacaatatgagagttggataaagaaatccattcgtcctgaaatgtatgccgaagtaatagctgccaatggtgaatttcccggagcatatatgactacttccgacggccgtttaggagtagctcgtttgcaatttggaaatgtggtgctcttgccacagaatgcggccggtagtggggataatgcatttaaagtagtacatggaaccaatgcagctcctccacatacttatattgcttcttatctgtggacacaattcggatttaaagctgatgcgttgattcatttcggtactcatggcagtttagagttcactccgcgcaaacaagttgctttgtgcagcaatgactggtccgaccgtctggtaggtgcattacctcatttttatatttattccatcggcaatgtaggtgaagggatgattgctaagcgtcgttcgtatgcgggattgcaatcttatcttactccaccttttatggaaagtagtgtccgcaccatttatcgtgaactgactgaggctgtcaaaacatacaataatttacttccggccgatgggcaggctgtactgtctaccggaaataaagacgctttgaaccgtgcttcattggcggtaaagaaactcacggtgaaactgggcatccatcgtgaattggaattggatagtcttcttactgttccttatgccgaggaagatattcagcgtatagaaaattttgcagaggaactggcaaatgagaagattacaggtcagttgtatacaatggggattccttatgaacccattcgtattacttccagtgtgtatgctatggctaccgagccgatagcctatagtctgttggcattagataaactacgtaatcgtgcggacggacaggtagagaaacatcgcactctttttactcagcgttatttagaacctgcacgtgatttggtcactcgtctgttggctgatccatcgttggcttctgatgaattgatttgccgtattactggcattacttccgatgaacttgctaaagcacatgaaatcaataaatcccgtaatactcctcaaggcatgatgaccatgatgatggcattagctgaagaggctccggctgaggctaaaacacatgctgatatgagcagtggaataatgcaggctgaccaaagcggatgttcgaaaaggaatagcatatccgggtctatgaaagagaaaatgaaggaaatagcgaaaggtatgaatcctgagaaagctatggaacttgcaaaaaaaatgggtgcaagccctgaagctttaaagaaaatggaaacaggaatgtacaagagtcgtgctgtaggtatgaatacactggccaaagatacggttacaatgaaaacaacttctcgaggaaaacgtgaaaaagcggatagtgataaattcggaggcatggaagcgatgatgaaagctatgatgtccaagaaaaaagaatattctaaagaggagatgaattttgctttggctgtcgtggaagtagaacgtaccttgaagaatgtgggcaattataagagtgctcttttggaaagtccggaaagagaattgacctctatggtgaatgcgttgaacggaggatatacgcagccttcaccgggtggtgatcccatcgccaatcctaatacattacctacaggacgaaatcttttcgctatcaatgctgaagaaactccgtcggaatctgcatgggaaaaaggaaaacaattggctgacaacactatcgaaatgtatcgccgtcgtcataatgactctgttcctcgtaaagtaagttatacattatggagtggagaatttatagaaaccggcggtgctactattgcacaggtgctttatatgctgggtgtagagcctgttcgtgatacgtttgggcgtgtgacggatcttcgtctgattccttctgctgaattaggccgtcctcgtattgatgtggtagtgcagactagcgggcagctgcgagatattgccgcttcacgtctgtttcttgttaatcgtgccgtagagatggcagccaatgctagagaagatcaatttgaaaatcaagtagcagcaggtgttgtggaagctgaacgtgtattaatagaaaaaggtctgactccaaaagaggcccgtgaaatgtctactttccgtgtgttcggaggagtgaatggtaattatggtacgggtatacaaagtatggtgcaatctggtgaccgttgggaaagtgaaaaggaaatcgccgatgtttatttgaataatatgggtgctttttatggtagtgaaaagaattgggaaactgttcgccaatttgctttggaagctgctttgacacgtacggatgcggttattcagccacgtcaaagcaatacatggggtgcattaagtctggatcatgtgtatgagtttatgggaggtatgaatcttgctgtccgtaatgtgaccggtaaagatcctgatgcgtatctgagcgactatcgtaaccgtaacaatgcccgtatgcaagaggtgaaagaagctattggtatagagagccgtaccacaatattcaatcctgcttatattaaggaaaaaatgaaaggggaggccggcgcagctaatacttttgctgagattgtgcaaaatacgtatggttggaatgtcatgaaacctcaggctgttgataaggaaatgtggaatgagatatatgatgtgtatgtaaaggataaatttaacttgggagtgcaggattattttgaaaagcagaaccctgccgctttggaagaaatgactgcggtaatgatggaaactatccgtaaaggaatgtggcaggctagcgggcaacagatagcggatattgccaaactacataccgatttggtgaataaatataaaccgtcttgttctggttttgtttgtgataatgctaaattacgtcagttcatagcttctaaaacggatgcacagactgcatcccggtataaggaaaacatcagtcagatacgtgaagttgctgcttcaaaagagcaaaagggtatggtgatgaaaaaagaagagatgaatacagtcggtacggaacaacagacgaatacggtaagcaatactgttgtttgtgttgtagtggtggctgcagttcttgttttaattgtattggtgcgttgtcgccgtaaaaaaatgcaggaataacaggctatggaaacagttgtagttgttcttatgatattggtctgtttcaattttatgatgaaacagacatttcgtaaacgaggatcggttgcagcaatagctgttgtagccaccctctttgtgggactgatgtggccatatgctattcagcagtctaagacacagattgctgattggttggcaaatgtccaattgatgcttgacacttcggtggtgcttacagtggaagttgccttacagatggctttttgtatgttggctgttcatgtgcttactacagggcctgttaagaaacgtactctttgggcttaccgtgctttacgttggtttccggggattttgatatttcctgtcttgtttagcggattggtatatcttatcttctcttttccgggtgtttccttttctcttgtcgcatggagtatggcggcaggtgtattgatattgatttctgcaggcacattgtttcttcgttatcttttgccggaaaaggaattacggttggagctattgttcctcactaatgcattgaccgccatattgggaattattgctactgtaaatggtcgtaccgccgtaacaggtgtaagcgaggtggattggggggcattgaccggcttgataattatgctggcaggtggaggactcattggattggttatatataaatatagacgaataaaaacaaacatttaaaacttactgacattatgaatcttatatcagacattctgttttggatttcgaacggacttttagtccctgttgttgtattgcttattattcttttcatccgttcgctattattgataggcagttttttcgggcagtatctggctattcggcgtacggatgcgttgttgcgtcaacagcttgatacactgactatagatactttgcccgaattggaaggcaaacttcctgtgaagtcgaactcgttggtcattgcgtatatccgtcgggtgttggagtcaaaagaccgtccggcacatgtgcagcgcctgttggctgattttgaaattactgctgataaggatttggctatttcaaaaacattgaccaagatgggaccgatgcttggattgatgggtacattgattccaatgggacctgctttggtgggactttctactggtgatatcgcttctatggcgtataatatgcaggtcgcttttgctacgactgtagttggtctgttttctagtgctatcggtttcataacccagcaggtgaagcaacgctggtatttacaggatatgactaatctggaattcctttctgaattgctcactgaaaaacgtacagcttgagatgaaacgtaatttattaagaaaagaggaggatagtgacccgatgagcgtggtcagcaatctgtttgatgtggcgatggtgtttgctgtagcgttaatggtggccttggttacccgttataatatgactgaaatgtttagtcaggaagattttacgatggtgaagaatccgggtaaggaaaacatggaaatcataaccaaggaagggcagaagattaaccgttataccccttctgaggatcaggatgtcaaaagcggcaagaaaggaaaaaaggtgggtattgcctatgaattggataatggagaaatcatttatgtacccgaagaataaacttgtataaaggaaagggaggataaagttaaaactagaacttgccattttatatagctgaacagaatttatttgagaaatatagggcaaataaagtaacttgacttcgtgagccaagtaagttaagtgaaagtgtcaagtaagttaagttacttgcccaatgcacttaagttacttttgaagctatcggggattcatccatcctattttccacaaattaattctgttcggcttttagtttgaagtacctttattacatacatatgtgtggtccgatatatatatgtatgtaataaaggtattttccctttttctagtatcggttgataactttttttgctttgtttacggcagtggtaggagaaatcttatccatgcttgattcatcaaacattttcaaggttttgtctatattcttaatagctcctttattgcctttttcttcaaattcttctttcagaatgcgtactttctcaaaaaattgtattccttctgtcaggcgttccaaccggatggatgaacgggcgcccggataaatcatatacgtgtctccggcagcccaagctgtgaaacggctgtcttgtaggggatttttcacccagctgtttaaagcccaacgaagatatccgtccagattttctttcgcactatgccatgccagccattcagcttcggcaggttcgctgaaagtgaaagtgttggggcggggctctgtgcagcaggtataataagtagttactttgcctgccttccggcgcgcttcaatctcttcgggagcaaatttctcggcaatggtgatacaataatcattcagatcatccaatagttctttgtgataagttcctgccaaagaaactttaaagtctttatcagccttacggatcactttcagtgtttcctgcatgtccttcatcgggcgttcgtccatcgcaatgtgagtgatatcgaaccagccttttgctttcagatgctttgagaaatcttgcagcatattcatccaaaattcttcataagcaacttcacccggtttggcgtccagaaatttgaaagagttgctggcctgatcaaaatattggaaagaaaggcgccagggaaccatagaatagcaactgatttgttttttgacaccaagatccatcataaattccacccacttgtcgaatacggtatagtcaaaataccaggttccatccgcttttttcaaccaagtgaccatgctttcaaaagcgtcataggtctgtccgttccagggcttgtgcataatggaggctgtgattaccttaccacctgcatcggcatacagtttcatcaatgggcgcatcaaatcgaaatgttttttgctgaacggttccacattgtagtaacgggatactgcataagggttctgccataaatccagatggaaagcccattcggaaggaggaggcagagtacggttcttcacttggaggttcagttttaattcagacaaggtgataccgtcggctttcactgtgacggttcctgtgtattttccggctttagtgccctgagggatgtttacgctgatccatcccccttgggtggagttggcgggaagggttagagtaggagtgatatggtctattacatctgctactaaagttgagtcaaaatcagcactgtttcgatagccacatgcgcccaaaccgtctttgttcagttcatcggttataacgtaacggacaaagcctgttcggatattctctttactgatggttgcactgcctgaggttaaatcgctgaccatgaaagtcaagtcatttagcgctttgggagtccatactaccagttgggctgaaattttctcacctttccatgcagtaagattcatacttttctgcgcactatggatgggagccggttcctctttcttatagcggatgtctgtgcttccccagctgatttgtggagctgtaactttcgcccataaagcggggttggtggcaataggattggctgcttcctgataatattcggaagtttgggcgttcatacatactgttgacaacaggagagcgcctagaaataggagttttttcataggttatataatagttagttgaagttacaaaggtaactcagggagagttaatttccaaataggaacggtggagtttgcataattgcataggaatatttatttttgacgagttataataataaggaagatagagatgaaaagaatggtaaatgtgctttttgctggtgtactggctatgactgtactgtcctgtggcgaagagaaaaaaggatatactctgaatggagaaatatcggatgttaaagatggaatggtgtatctgaaaaaatatcaggataaatcgttcatagctgtggattcggctgtgattactgacggtactttcaaatttgaaggtgtttgtactgagccattggcttatgggctgactacgttcagggatagcaaacgtccgttggtattctttttagataacgaaaagatgcagttgaagatgaatgaatcagaaaagatactgactgtgacaggttctgccattaatgatctgtatgcacaaaatgctcctttgactcgtcaggatggatatagcatagatagtctggttgctgttcacccggcatctgctgttaccccttatttcatagtgaaggatttcgcttataagttgaatttggaagaaatgaaggcattgcgtgccaaactggatgcttcattggatgaaaccatgtatgtcagtcaaatagatggctttatcaagcggatggaagatattcaggtcggtgctgtggctccggattttacattgcccgatgtagacggtaatcctgtcacattatccggtttgagaggaaaatatgtactgattgatttttgggcttcctggtgtcctgattgtcgcaaggaaaatccgaatattgttgctgcctggaataaatacaaggataagaattttactattttaggagtttctttggatcgtaagaaagaaccttggttggccgctattgagaaagatcaattggcatggactcatgtttcagacttgaaggactggaaatcggatgcagccgtgcagtatgctattcgttggattcctatgaatttcttgttggaccccaatggggtgatcttggctgtaggattggaaggggaggctttgcaacaaaagctggatgaggttttgaaataacaagtttgctgtaagattatgaaaataaatgtaccaaaagccaggggttacagttggttctccattggcttttgatacattttgttgtctttgttcacatcattgttctttctctttagtcattatcacgtccgaaggaacagaaaatcctatcagttctgtatattcatccggttcttcaagggctaatcctaatttttcatccagatgccaacgaattttatcggaagaaagcagaagtatttttccgcctaatatcccttttccgccgaagtgcttcttccgttggtcgtaaaataaaactccgactcgattaggatcaatgtagtccaaactggtagcattgtttgaagcccagatagaaaaatcttgagttcccttttttttgtccaagtgccaaatagtatctctgatactaaaatagttttctacaattattcccttcactgatagaaaatatcctcccataagaccatttataatcatgtgttgatcctctgcatatccttttttaagaactattttaaaaatcgtatcatttgactgatacatccaagtcccgatataagcatccaagttttttgttggagcaatttccttttgggcaaaactaactgtgctgataaaaaacaaacacaaaacaaattctattcttttcatgacttttctttttattggttacattccatatttacagatttcccattagaagctagttcctgagcattccaagtcggattgctttcatcaatattcgaactaaacatcactgacagaccggagttattgcgatctaaaaatttaagcaactgacctatacattcatcaactccccctccgcttgcaccaactatataagcgttccaactttcggaaagttcaccatttcgaactttggtagcgaaagtattaaaatctgtgggagaagttatcataatactcatacatccgaactctgaaactactccataagtaaaattctctgatttcacatatccctgttggtatcgtatagctaaagcctttaaatctgcccatgaagtaatcatagagcctgtagggtgggaatggtaccattccatgatttcttttcctgctatttgatcatttgtgaatttggcacttcctgattcttgtacgttcgggaaaatagtttgcccgtctgaagtctgtataaagccttgctccacagtattgcctgcggaaaatgtttttctatacacatcttttatacgcgatttaaatgctgcgtcctgcgacaatgttttagcacgtttacaaggagtaggaggtgtttcaggaggatttgaaggaggattatatccaccacctccgccatccatttcgtcatcatccaatgaaacgcaaacttcatgatactcaggatgtaaatacttgtcgcaaattacatcgatgccgggcagccccagttcatgatcccaaacgatatcattatgacaattccgcttttccatccagtctatttccgtattacatacggattgtcctcttcctctttgcaaactcatacggtatccttcctctgttcccggagaaatggaggctgttattttccctgattcatatttccaaccatttaccaatccataattgaaattgtagaataaaacttttccatcaaaatcagcttcacgatgtaaataagaattgttttcaaaagaggtggtatgcatcaaataatcataagtacctatgaataccatgatgaagttgtaaatctcacctgtttctagattcttcaatattaccatgcgtgctacattatatattttatccaaatcatcttgtagttcatatttttcttttgtctcgttatccataaaaaatgtactaccgcttgtcattagagtcgtttcaactacctctaaatctccttttttactttctttagccttgttccaattaggctttgctggaattcgcccgtcagcacttaaggatctaactgtagtagctgagggattggtggcattataccattgttctgctttagcaatggtcaattctttattgctgtcaaaaataacttcatcagttacattggaggaccattcatcttgccaacatgaataaactatcatactgacaaaaactaaaatgccaacaatagaaatttttcttttaagtgtttttcgtttcatagtatctatttttgatttgtggttagtatgggttgagaatatttgcaataatatcaaaaaaagtaactttacaaaacccttaagtaaaaagatagttattagagagcctttatttaaaaggcttcggcttcgaagctatctttttttcgaaagtatctgtaataagcgttagtgccccatctccggtaatattacaagctgttccgaaactgtcctgtaatgcaaaaatcgtaagtagtaatgccgttccggcttcattaaagtgaagaacagagatgattagccctaaagaggcaagtactgttccccccggtactcccggtgcaccgatggcgaataatcctaataacaggatgaataaagtaatttgtaatatactgggcatacttccataaagcatttgggatacagtgagtacaaatacggtttctgtcaggatagagccgcataggtgtatattggcgaataaaggtatcgtcacatcactgatttcttttcgaaggatagggcttttgcgggcacattccaacgccactcccagcgtagctgctgaagacattgtacctaatgctgtgaggtaagcaggaccatagtatttcaatacctgccaactattttttcttgagtaaacagctgcaatgaaataaagcaatgacagccagatgaaatgacaaacaataacaactatcaatacggagaggaataccggtaactgcttcgtaacagctccctgatagctaagaatgcagaagttagcggcaataaatacgggaagtacgggaagcagtactcttttcaccaattcaagtaccatcttttgaaaagtatccagtagttttgatatttcatccgatttaacccaagcagtagcaagtcctatcaaagctgccagtacaagggccgtcataacattcatgaccggtggaatatctatttttagtaaattttccggcaatgctttcagtgtattggcatcatcggctatatgcagaaaaggaatcacattgtaacctacggctgctccgaaaaaagaggctccgatagatgataggtaggctatgccgaaagcgaataaaagcatctttgatgcattgctgcgcaaatgggcaatagagggggctatgaatcccagaataataaggggaaccaggaaaaatataatctgtcccgtgatgtgctttatacagataacgacttccagcactgcgtcattaacaacaaagcctgccaacagtccgataattacggcaataagcagttgtacgatagtattacttagaaactttttcatatatttttttcagttaaacgatgaatatccggaaaaagtttgctgtataggtatgttatttcatagcttgaacaaagatagaaaaataaaatagaatgccgtatgaaaaatagaaaaagacgggaaacatcacgctccccgtcttacaaagtctttttgccttatgctaataccttaaattaagcgaaacatttagactctctcttataaataatcattattattggaatatgaattaaaagttgtttttacctgtatcccaccatagacgggtaccgccgttgtctgcaccaccaagagccgtacacagatttttatactgctcaggatcttttttggcatcatcttgtgagaaggggaggcggcgaatcatgatgtctgtatcaattgtaccattgctgttgttggtttgtactttgaataatttcggatatccggtacggcgctgttctgcccatgcttccatgccttctggccagcaagcaatccatttttgagtgataattttttcaagttgttcttcttgattaactgcatcgtcaaaattgggagtggtggttattaatgctttcatgtcttttccggggcctgctgcgtaattaatgtaatctgtcggtttacctttacttgtcagatataggcttgcatttccggctccccattggttgaatgaagtttggacaccggtttcataacattgctttgcgctttcgtttttcggattgatacctcgtaaagatgcttcggcacgtaagaaccaagtttctgctgctgtcagaagaacggcgggtgtggatgctgtgattgtttgggtgttgataaaggaatagctttggtaataattggggtcaccgtccttggcatatactccttgaggtactcctagatattcctctgtatgctctgccaatgtcgccggattataatatatactgatgcgtggatctttataaccgtttaggacagaagctattgttgctcccatataggtttctccccaaccggcaacacctgctaacgggttttgataccccttaccggagatttgtatgttttcatcagaagattctatgacaccataagagttttctaatgcttttcgggcttcactggtagcaagtgtcttatttacattagatacgcgcatagctagacgaagacgtaatgaattggcaaattttatccatctgctggctgtaggacaattgcacatattaatgcttttcacgccatcttctttgccgccttctttcaaataagtatccaatgcgtctacagctttatccagatcatcaaagaatgctttataagcttcttcctgggtatcaacagagtttgtttcgttttttccgaatttagaatagacaatagggccataagtatcagttatacggtgcatggcttctacttttaaaataagggtcgcaccataaaaatgtttgtatttggcttcatcttgtgtaattaatgttgatttatgggctactggaaatatataattataagtataattccacgcactggctgtccatccggcctctaatgcatatactgtatttttatcgctgaatttggaggcaaaatcatgaaaatatcctgagaacatatcatgattcaagttttggaatgtctgccaaggccaagtggtgccttctccccagtcgtagttaaaataaatacctttttgaattgtctcaaagttagtagtgtatttttggaaatcatattcttttacagtatcatcaaaactaccgttgattttattgtcagattcgaatccgtctgtgcatgaggctaaactcagaaggcttcccacgcataaaattgaaatatattttgaacttttcataatgtctttgttttaaaattagaatgtaaatttaacgttgaaaccaatattacgtgtagtcggcatgccgaaaacatcaacgccctgcagagtattacctactgataaagttgcatccgggtcaaatggagcatctttgtacaaaaagaataagttacgtgcaaccaatgtgagatctaatcctttgatgaatttggttttggcaaggagggtttccgggaatgaatagcctagtgtcaattctcgtaagcgtacattcgttgcatcatacatatagtattctgagatgccgttacgtcctccgactgtaccatagaagttaggaacatctttgaattggatgccttcatattccacataaccgcgatcacgggattctccggattctttgctgactcccattgcgtcaagatgtgcttgtgtcaatgacatgacatctcctccgatacgtgcatcaatcaagaaatacaaagtaaatcctttgtaagtaaaggtattgctccatcctaataaagcatcaggattagcattgcctagtaaagtattgttacctgtaactttgattggatttcctgtctcgtttaatttaatcttaccattttcatctctttcgaatccgtttccataaatatctcccagttttccaccttcttttacccacatgtcataagccatggagaatccttcagaaccgtagcggaatgatttatagtccttgtgtaaggaaacaactttgtttctgttcatggacatgtttacagcggttttccaacggaaattttcattcatcaaaggagtaccctctagtgtcaattcgataccagtgttacgaattttacctgcattgatataacggaacgcataaagtgaaccagccggattggctactcttaacagttggttttttgtatctgtacgataccatgtaaagtcaattccgaaacgattattgaaaaacttccattctgtaccgaattcaatggaagtactgatttccggtttcaaatcaccacgttgttctatatcgtttgtttggatacttccaccacattgaatgatgtcagctaaattggtgatgccgatgggaaggtcattgccgacctgtgcaaatgaaccacggaattttgaaaaattgatccattccggtagtttgatgctgttgctcataatccaagtcaaacctactgacggatagaaaaatccatttttcatactttctgtgtttgccagggtggaagaccagtcattacgtgctgtaatatctaaataaatagcatctttccaacccacttgtgctgtaccaaataaagattgtatagtacgtttcgcatcaattgtttggttgatatatccctttgaagagaatataatattggaaacggtaaatacattaggacgatataaagatgctgttttggagtcgatcattaaagaattggctttactgacgttaatgctggttcctaatgcggcattgatggaaaaatcaccaaaggttttgttgaacatggccatgaaatcaccatatacttggaagttttgttcatccgaccatacatagcgtccgttaggtaaccctgtttcatcattttttccggcaatgtttgctgctgttgatgcatacatcttgttgtcaaacttatcacttacatagtctacattcccgcgtgcctggatacttaaccagtcagttgcttttatatttgcactgatagaagctaatgcacggtaacgtttactcttgttggtcacacgattttttatccagtacggattctgatcccattcgctgaatgagccgtcttcattttttgtataccaattctgtaagttcatattgcggtcagtatcgaaaacttcaaagttttcagcgtagggagccagatcggcaccacggggaaaagaatacaagccaaccagcggattcagataataaccacctccggcaggagtattacggatagtttgtgtcatcaaactggcatttccgtccaattttaaacgatcattaaagaaactggctgtttcacggaaagtaatattgtgcttttgaagcttatttgagtccacgatacctgtcccccgggtattggcataagaaaagtaagtttgcattttgtcattacctgtttggaaggttaaagagttgatggctgtaataccattgccaaaccaattacctacgttatcatagtctgtcagatttcctttgtcgccccaactgctggtaccatcggcagtttgtccataattgttttgaaattccggcaggctgacagcatggtctactgtcaggttagaggagaatgtaactcttgacataccggctttccctgattttgtagtaattaaaataacaccgttggcagcttgggagccatagagagcagcggcagacgcaccttttaatatactcatactttcaatatcatcagggttcaagttggaaacaccgtcaccagagtcatggttgaccccgtcattttcacctcccataacggtggctgttgattctgttgtgatattcagcataggaacgccatctatgacatataacggttggttgttaccactggcgaatgctgaacgtgcaccacggatagatacttttgccgaacctcccagaccggatgaactctttgttatttgcacaccggcagatttaccggctaatgaattgatcatattagcgtcctttactttattcagttcgtcaccattcagttgctgagtggaataagttaaagaggcttctttctttttaatacccatagcggttactacaacagtttccagtttcaatgcgtcatcttccattttaatggtaaaattagtctttccgtttactggaattatgacttttttataaccgatataagatataaccagttgtgcatcagccggaacttctaacgtaaagttaccgtcaatatcggtaattgtaccgttagtagtaccttgttgaataatgtttgcaccgataattgcttcaccttgcatatcagttatagcacctttaacagtgattgtattttgctgttttacttcctcacgggctatattgctttcttttgtcaaaacaatgtttttaccttccataacataagtgataccagttccggaaaaaacttcatctagaatttcggatacggctttattttttgcgttgatttttaccttgcggcttagatctacatttttcttactatagacaaacaggtaattagtttgtgattcgatggcagaaatcaattgggctaccttcatgatgttggtatccagactgactttggcgttctgagagtgtacatccatactgaatgcgctgaatgctgtggttaacagaagaattaaggtgatcttcatagttcgtaatatttgtttaaaagctaaactttttgggcataagtacccttccaaagaaatttttctcatatctttgtaatgtgttaagttaataaatttgattaaggtcaattgttagctgtcgaatcggggagtatgggggtactttccgattcttttttcaaaggtttttatgtaatcataacagttcatttttaaaggttaaacttctattgtgattttattctatggttatcttgttatgttcgttatcaatattgtatttaaacggatggtctttttgtataacttttagtatatgttctatgccgtccaaatctttgaatttaccagtgcagcggtagttctctaagattttaggattcttcactgttatcttataattataatatagagcaatcttgtccagtaactctttaaacggaacatcatcgaaataataaatgccttgcatccatgccaaagcattgttactgctcatttcgcccgttttatatttgccgttttccattgagaaatactttccttttgtcaggctggtaattggcttttcttcttttgcattgttggtaagcaagttgatggaaccttctatcagtctggctataaagctgtttgaacctttataggagcatacatcgaattttgttccggtgacttgcacctttatgttttctgtctgcacataaaaaggaatctccttattgtgtgccacctcgaaataggcttctccgtctaacgtgactttacggtcttttttaccgaagttttcatcataagttagtgtggtttgggaattcaaccatactatagaaccgtcaggaagatccatctgtgcacgttgacctgctggaatacggatggtttgtgacaattgttgtttaggtttatgcatatgtggcaaatccattacaaaaacaatagccagcatggcggcaatggcaatcagtgggtacaggtacagatgccctttcggtttccgttgtatgttcgaaccgtcagaaaaaagggtgacatcaaacagcattcgctcttttagaaagtgttccttgttttctacactgctttctacccattccacaatctggttttcctctttttcggtggtttctcctctgaaatatttatgtagcaattcggttttcattctttctgcattttgtatatagaacaggatagctggaaacaaccctagtagaaaaatgatttttttttcgattttctcaaaaaaagtgctttttatcctcttttttcatttcaagtaaaattattacccccctgacacactgctaataaaaaatattagtaactttgcaacacccaaaataagcgagattgtatttatacactataaacaaaaataagagattatgatgacaattgacaaattcaactttgccggtaaaaaggcaattgtccgtgtggacttcaatgtacctttggacgaaaatggtaaaattactgatgatactcgtatccgtggtgctcttcctacactgaaaaaagtgttggctgatggtggcagcttgattatcatgtcacatatgggtaaacccaaaggtaaggtaaatgctaaatattcattgagccagattgtcgatgctgtttctgaaaaattaggtgtacctgttcaatttgctcctgattgtgcgaaagccggtgatgctgcagctgctttgaaaccgggtgaagtcctgttgttggaaaatttgcgtttctatcctgaagaagaaggaaagcctgttggcattgacaaagaagatcctgcatacgaagatgccaagaaagcgatgaaggcttctcagaaagaatttgccaagactttggcttcttatgctgattgctatatcaatgacgcattcggtactgctcaccgtaaacatgcttctacagccgttatcgctgactatttcgatgcggacaacaagatgttggggtatttgatggaaaaagaagttcaagctgttgataatatcctgaaagatatcaagcgcccgttcacggctattatgggtggttccaaggtgtctactaagattggtatcattgaaaacctgatggataaagtggataacttgattctttgcggtggtatgacttatacttttgcaaaagctcaaggtggaaaaattggtaattctatcgtagaagatgacaaattggatttggctcttgatatcattgctaaggctaaagctaaaggtgtgaatttggtattgggctctgattgtgtggctgctgatgcattctctaacgatgctcatactcaggttgttcctgcaaataatattcctgacggatgggaaggtttggatgcaggtcctgaaactcagaaagcatttgctgctgctattgaagatgccaagactattctgtggaacggtcctgccggtgtttttgaattcgataactttactgccggttcacgtgctatcgctgaagctatcgcaaaagcaactaagaacggtgcattctcattgatcggtggtggtgactctgtagcttgtatcaacaagttcggcatggctgaccaggtttcttatatctctaccggtggcggtgctttgttggaagcaattgaaggaaaaattcttccgggtgttgcagctatcaaaggtgaataattaattttctgctatatataaaaaaggcagccttttcgaaagctgccttttttatattctttattttgtacttttcagaacatgaacaaaactgttgctaccagtctgttgtttgaaacagaatgagtatcaataatttttccgttagaacttttcatggaaccataccatgcggaagtaagattgtattcaactcccaatttccagtgaggcacattataggttagttctgcgctggtacttactaattggtctacattggttcctgtaccatacattttacttatttcgtcactcgttcctaaatttttcatataacctaaaaaaacagccggtttccatttcttaccgtatgcaatattcagccatgaactagaattccggttgggggaatactcttgttctcccgtacgggcatcagtggattttacaccgtatccgcccagcatggatacttgtgtaagattggaacccaaaacactttttgctgccacataccataggggagaagtatatttcatgtgaacttcgtaagacagggcagtgacacgttcatccactttgtaaacttcatcttctactaccgattgagtacgaggttttaatgaaatcatttcaatgcctgctcccactagccagttgcttcttttgtaatctgcaccaatatagatttcgggtatacaactttcttttatgtatttctggcttttcccatcaggaccttgagacaggtattgggattgccaaatagccgcgcctgtcagttgtatatcaccagctttgtagcggaatcgtatttgtggggcacggctgaacggttggaaaggagctcccatattcagattcagaatttgtggagcaacgtcaccatataacggatgccaggtttgtcccaacagtaaagacggttttccccaatcaaggtttaaataggcatggcgcagacgtacagtggagaaggttgttcctgatccgcggaagtccatttctacttttgcggaggtttttgctcttcccaacctgggaccttgcacatctattcccaaacgggtatataaagtataaaagcttccattagctgtcgcattcaggtctttacctgttgcatcgtacactttatctttaggatacatatagaaaagcccgtcaacagtttcttcattggcacgactattataatagaagtcggtgcggatttgtccgtagaacttgtaattgaaatctttgtcttgagcaaaactttttgccgatagcagtaaaaatgtgaataaaaataaatattttctcatattttaaagggttattataaacagtcggcaaaattacataatttatttgaaaatcgcacgtgtgtcttggtaaaagaattatgcgcctctacatataaagtctgcaccgatacaaattatttttgttgcctcattcaaggcaacatttgaatcttgtcgtattcttcatcagttacgggttctaaccattcattggatgtgttttctccggaaagttcgaatgcaaggtgggcgaaccagctgttggcggctgcaccgtgccaatgttttacgttggcagggatatggatcactgtgccgggaagaatctcaacggctgctttaccttcctcttgataccagccacgaccggctatgccgataagcatttgtccgccaccttgagttgcatggtggatgtgccagttgttacggcagcgtggttcaaaggtgacattggaaatgtttacctgttcacgagagataggggcgaggtaactgttaccagtgaaatattgtgcataagcggtgtttggttctccgataggaaaaatcatttcgcgttggaacgttgttttttcatctttatctttacaagagatttcttcattccatacttctttggcaagacggaatgccgcccatgctttcggccatcctgcatagaagccgatttgagtgatgatctctgcaatttccgtacgcgtaataccgttgtttttggctgattggagatggaatgtaagcgaactgtccgttattccttgactgatgagtgaggtgattgtgactaaactgcggtcacgaagaccgagttgctcggtgcggctccacacttctccaaaaagaatgtcgtcattaagttccgcgaatttaggagcgaatgttcctaattggtcgcgtcctgctgtctgtttgatctttttttgtgccatactggttgttgttaaaatactgaatattaaaagtaaaatgactttgttcatagcgttcatattttaagtttttcaatataaattctatgtacaaaagtatggagttgaaaaaaataagattgtacccggattacagatttttataccatttttcctgtttggtttgttgtgctttttaaaatgaaattccattgtcatccggctaagttttcaattaggaaatagaaaacaaggttttgagccggattacaatggaattcaattcttcttatataaataggtaattaatagatttctatttcgtccaaagctattgtgctgggtacctcgcttttatcatgtgggctatagcaatcaataccattgcgtattttacctccgcttgtaaattctatttttaccttcaccgcttcttgtgccggaaattctatttcttcatcaaaacctctgaacgtattttctttgatatcgtaagtgaattctttttcggctactttctcgaatttgttgtctaaagaggaaacatagactacagctttgctcaccggcaatattccacctgctgcattatacaatgtaccgaatctgattttacggatagtggctttctcaaagtctactataaaagtaactttgtcattattgtctgggctgatacctacccacggggtggaggaggcattatttccacgttttccattggtcagtcctaaagtcacagtgtctgcgcccaatatatcattttctcctaaaatatcacctttcatacctttgggttcgggcatgatttcatattttttcccactgattaaattcttgtaaagctgtttatgagtaaccttaccgatttgtttgccgttaacgaaagcagcggctttcaagtcgtatgtgccgtccaatgggaatggacgattgtataagttggcatgtatggatggttgctcaccatgagtcgtataatagatttgtgctcccggatagaatgtttccagctctacattcagtacaccttcttgggtagcacgggtgttgatatttacatcaaagaagttgaggcaaggttttacgcccattgcttccagacgttggaagtcttcaaccatgcggttgcagaatgaagtaaaattctttttcttcatcggagtccagccggtttcggatatagcgatcaggcgtgggaagatttgataatcacggttatcctcagttggcatatattctgcccagcaattggcctgtacaccaatgatgtgctgttttaccaaactgtctgcatcagccggtacaggattatagctgtatgtctttttcagtgtgttgtatccaccgatagtaacaggggctatttccggttcttcctggtaatggtcaaggtaagcgtaaggattaggagtcataatagcatcatgtccggctttggctgcggtcattccgccttccacaccacgccatgacatcactgtggcgttgggggcaagccctccttccagtatttcatcccaaccgatgatattacgtcctttgctgttcaggtatttttccacacggcttacgatataactttgtaatttctcttctttcgtatgctttcttccgtctacgggattgggagtgatgtcattttccaatcccagttcacgtatcagtttttgacaatgttcacattgttcccaggctgttttaggacattcatcaccacctatatgtatataagagcttgggaataattccaccacttcgtccatgactccttccataaactggaagaaggtgtcggtagggcagaatacttggtcaaacacaccccataatttgcaaacttcgtaggtgctgtccggagtacaggacaattcagggtaggaagcgatagcggccaaggcatgtccaggtaactctatctccggaatgacagtgatatatttgctttgagcgtatgcaacgacttcttttatttcgtcttgtgtgtaaaaacctccgtggggcttgccgtcatatttgaatgggtaatgggtatagaaataatccaccatggtttctgaacgttgagagccgatctcagtcagtttggggtattttttgatttcaattctccagccttggtcgtctgtaaggtgccagtggaaggtgttcattttatgtgcagccaatacatctatgaattttttgatataatctatagatgcgaaatggcggcatacatccagcatggctccgcgatagcggaatgttggggcgtcttctatttcaacgcaaggtacactccattcggcattacgtgctctttctttacaatagacatccaccggcaacagttgatacagggtctgtaatccatagtaaaagccgttaggcgccgatgcggtaatttttatcagttgaggggtgaccgataacttgtaggcttctttttccatccccggaatgctgtcaaaaacaatggagggtacattttcatgtaactcgtcagtcggtttcagcttgagaccggctatatccaggagagtggttgacaggccggaagcaatgtgtttcacttcttgtgaggcgttaacgacgataggaacatcactgttcaggtaaaaacgtccctgctgctcgctcatggtaacaggcaatggaactacattgtactcattgattacttctttcatttggcatccacacattaataacccaacgaaaaatactggcagactctttttcttcataataaatctgtgttaagtttttaaataaagggggtatagaaattctttttggacaaaaatagcaataaaaacggaataaacatgtttttcagagagattaatatgtttacaatataaaaatatttttcacagatttgtttctttattgctaatagaatgctatctttgtccgagttaaccaatttattaatctaacgcgcatgacagcaaatacccccaaacggttgcttgctcttgacatcttgagaggcatcactattgcaggcatgattcttgtaaataaccccggttcatgggggcatgtgtatactccgttggagcatgccgcctttaacgggttaacccctaccgatctcgtttttcctttttttatgttcattatgggaatatccacctatatttctttgcggaaatataattttacttattctcatgctacattacggaagattgtgaaacgtacagtcgttattttttgtatcggtctgtttttgaatcttctggccaaatcggtttttacacatcatctgaattttgaagagttgcgttatttaggagtcatgcaacggcttgctataggatacggtgtgactagtctggttgctataacggtgaagcataaatattttcccgctatcattttggtgactttggccgtctattttcttttattggctatgggagacggctttaacttgtcggccactaatatagtggcccgttttgatgtatgggcattgggtacatcccacatgtaccatgatggtggaatggcgtttgatccggaaggactattgagtacgcttcctgcggtgtgccatgtaatggtagggttttattgtggaaagttattgttttctgctaaagataatgacgagaagatacaacggttgtttttggtgggtacaattctcacatttgctggctttttgttaagttacggctgccctatcaataagaaagtgtggtcgcctacttttgtcattacaacctgcggattggcatccagctttttggctctgcttatctggatcattgatataaaaggttatcaaggttggtgcgtttttttccggtcgttcggagtgaaccctttgtttatctatgtgtttgcggaaataatggggattctattgggcgctacgggggcaagtgtctttatttatgaaaaggtactggttccggtgttgggaaattatcccggttcattagcctatgctttgttgtatgtattattttgttggagtattgttcatattttatacaagaaaggtatttatgtcaagatctaaaaacggaaacagaaaattagttaaatgaaagagacgaagaatgtttttatgtcagaactgacggaggtgtttagcaaacgtcagcaacagtttgttcagtttgcttactcgtatgtcaggaacagggaagaggctgaggatattgtaatgggggcttttactaatgtatgggagcaccggaatgagttacaggaggataccaatatttctgcgttgctgttgactgccataaaaaatcgttcattgaatcatttgcaacacttggaggtacgtatgcgtgccgagcagcatataggagatatgcggcagaaagaactggctttgcgtatctcgactttggaggcttgtgatcccgataaattgttttgtgatgagattcaagctttggtgcaggaagccattagtgaattgcctcctacaagcagggaggtgtttattttgagccggatgaaaaatttaccgaacaaggaaattgctttgcggctggatatttctgtaaagactgtagaatttcatatcacccggtcgctgaaacagttgcgggtgcagctgaaggattatcagtttctttggagttttttataaaacaagaccatgcctcggttatttggacatggtcttgttcttatttcatatacaggaatcagaaactataatctgcacttaaaccgaacactttgttggtacggctatatacatttgttccgggtagtccggttccgttatagttggttgatttttttgtataatcctcataattagtccacatataaccaacatttaaattgaggtgtttgttcatctttattttggctccgactcccaaagagtaagaatcacaagaaaaactggtatctgattgatagttatctgatagtccgtagtcagtgatttgtccaccacagctgagggttagttgcttggttacatcaaactcaatacctgccaagtattcattggttcctttagtcagatatttttgtttgccgtttgccatacctgcatttttgtcatcataaaaatgatattctacagaagcgcgaagtaccggaaggaattcgtaggcggctgcgatagagagcatggctgggatgtcattgggggtgtttacaccgtgtttgtaaggagctatcattgcttcaccttcaggagtccggggatattctatattctttgtattgttttcgatattcaagttggtcttgaattcatatttggcaccaatgttcagtttacccagtttagcatctacaccgataacaggagtaagtccccagccggtttggtcacagtctagagcaagaggcaacaggtttgtgtctgttccttttacaatagcgttcagaaagcctttgtagccaccggtaaagtagttcattctacctccaccgaatacggaaagccattcggtagctttataggataatcccagctgcaaagaataaatatattgtttaccgtccatggcacttgttatatcatacatatcaggagttataaccgtaggtttttctgcttttaaaccttcttgaaaaatacctgccatagctgaggcgtcgaacataggcagtccgtcatcaaaagacgcctttccacctccggcagtgatggcgaagaatcctgaaattgtccactcaccttttttatatgcggcgaagaggctggggataaccggtgcggcggctgttccttcgtaatatttttcaaaaggcttgtctgcaacagtaggacctgtggcgctaacgccattgtatgtcataaaactggcatcaatatttctagtctgataagcgctctgaatgctcaatcctacatggaatccgtctttgggcaagaaagccaggccggcaggattagataaagcaccgtctatttctgttgtagcaccacgggatagcatacggagaaaagctgcatgttgatttgtattggttaaaatacctcctgcgaaagttgaatttgaaacgattagtgtcgctgcactaattaataatagtttcttcatttattacttgattttttgtttgcgggcgcaaaggtaggataaaataacacacgggcaaaccttttgtgcaattatttgtgtcgtctattgaaaaaatcaactgtttcaatagaaactatttacttggatgatgaatatcctttttttatttgtgtgattgattggtaggaactgtggaatgagggagcgtgctgatgcttttgtgatatatttgttccggcacgcctgtccgctaagtaaattcctggtctgtttacggtttcttcactccattcagaacaccggattgaaaagaatgtagtatctttgcaactcttttactcaatgcaaaaaaaatatatgtataccaacaaagaaatatggaacgtaagttatccgatttttctcggattattggcgcaaaacattatcaatgtgacagatactgctttcctgggcagggtaggagaagtcgagttgggagcttccgccatgggtggattgttttatatctgtgtcttcactattgctttcggttttagtgtcggttcacaaatcttgattgctcgtcgtaatggagaaggacgttacaaagatgtgggtcccgtaatgatacagggagggacattcttgctgggattggcgatgctcatgtttgggctgacacatcttttggccccatccattgtccgcttgctcatttcatctgattccatttttgatgctaccatggaatttctcaactggcgtatttggggctttttcttcgcctttgtcaacgtgatgttccgtgcgctgtatattggtattacacgtactaaggtgctgacaatgaatgcagtggtcatggcattggtgaatgtgctgttggactatattttgattttcggtaagtttggaatgccggagatggggattaaaggagcagctgtcgcttcggtgatggctgaagccgcttcattggcttttttcttgatttatacctacgcaaaggtggattttaagaaattcggcttgaatcactggcagaagattgacttttctttattgggaaaaattctgagtatttcgtgttttaccatgatacaatattttttggccatggctacttggtttgtctttttcatcgcgatagaacggttgggtcaacgcgagctggcgattgccaatatcgtgcgtagtatctatattgtgatgctcattccggttcaggcattgtctactactaccaattcattggtcagcaatctgattggtgcgggggggataacccatgtcatgcgtttgatttggcgtatagcccggatgtcgtttctcattatggtggtctgtgtggcggtggtggtgctttttcctcatgccatgctttcggtttacaccaacgaaccggcgttgctggtagagtctgtgccttcgttgtatgtcattgccggagcgatgattatcgcatcagtggcgaatatctatttcaatgccatttcgggaactggaaatacgcaggctgctctgatacttgaaatggggactttggtattctacgccctttacattctatggataggcatggtggtgaaagcaccggtttctgtttgtttttctatagaggtggtgtactatagtttgttactgcttagcagcattatttatttgaaaaaagcaaaatggcagaataaaaagatataaggttcataagttttttgtatttttgcaccctgttgttattctgaaggttagtaaagaaggacaggcaatcataattcgtaatttataattaaagatatatgttcgataatttaagtgagagactggaacggtcttttaagattctgaaaggtgagggaaaaatcaccgagattaatgtagcggaaacattgaaggatgtgcgtaaagctttgttggatgctgacgtgaactataaggtcgccaaaggctttactgatactgtgaaagaaaaagctttggggcagaatgtgcttacggctgtgaagcccagccagttgatggtaaagattgtacatgatgaactgactgcattgatgggcggtgagactgccgaattggtgttggaaggtcgtccggcggttatcctgatgtcaggtctgcaaggttccggtaagactactttctccggtaaactggcccgtatgctgaaaaccaagaagaaccgtaagccgctgttggtggcttgtgacgtttatcgtcccgctgctatcgaacagttaagagtattgggagaacaaatcgaggttcctgtatatagtgaattggacagcaagaatccggtgcaaattgcattgaacgctattcatgaagcaaaagcgaaaggttatgatttggtcattgtcgatacagccggtcgtctggctatcgacgaacagatgatgaatgagattgaggcgattaagaaagcggtcaatccggatgaaacattgttcgttgtcgattcaatgaccggtcaggatgcggtgaacacagcccgtgaatttaatgaacgtctggactttaacggtgttgtgctgaccaagttggatggtgatacccgtggcggtgccgctctttctattcgtaccgttgtgaataagcctatcaagtttgtgggtaccggcgaaaagttggatgctatcgaccagttccatcctgcacgtatggcagaccgtattctcggtatgggtgatatcgtgtctttggtagaacgtgcgcaggagcaatatgacgaggaagaggcaaagcgtcttcagaaaaagattgccaaaaaccagttcgacttcaatgactttttgagccagattcatcagataaagaagatgggtaacctgaaagagttggcttccatgattccgggtgtgggtaaagcgattaaagacattgatatcgatgataatgcattcaagagcattgaggcgattatttattccatgactccgcaggaacgtacaaatcccgaaatcctgaacggaacacgtcgtacgcgtatagccaaaggcagtggaaccagcattcaggaggtaaaccgtctgctgaagcagtttgaccagacccgcaagatgatgaagatggtgaccggtagcaagatgggtaagatgatgccgaaacttaaaaagtaaggtttaaataaacaggtagggagaaagtgcggaactttctcctttttttattatgcaacgtggctgatttatgctacatttgttgctcaatggattatttataaataaatagtatgcaactaattgatggaaaagctatttcggaactggtgaagcaggagattgctgcggaagttgccggaatcgtggctaaaggtggcaagcgtccccatttagctgcaatcctcgttggacacgacgggggaagtgagacatacgtggcggctaaagtaaaggcctgtgaagtatgtggtttcaaatccagtctgatccgttatgaagcagatgtgacggaagaagaattactggcaaaggtcagagaactgaatgaggatgctgacgtggatggttttatcgtacaacttcccttaccgaagcatatttccgagcagaaagtgattgaaaccattgactatcgtaaagatgtggatggtttccatcctatcaatgtaggacgtatgtccattggccttccttgctatgtatccgctacgcctaatggtattctggaattgctgaaacgttaccatattgaaacacagggaaagaagtgtgtagtattgggccgtagcaatattgtgggtaagcctatggcgagcctgatgatgcagaaagcttatccgggtgatgccactgtaactgtttgtcacagccgcagcaaggatttggtaaaagaatgtcaggaagctgacattatcattgctgcactgggtcagccgaattttgtgaaggctgagatggtgaaagaaggtgcggtggttattgacgtgggtactacccgtgtgccggatgccacaaagaaatccggattcaaactgaccggagatgtgaaatttgatgaagtggctcccaaatgttcttatatcactcccgttccgggtggtgtgggacctatgactattgtatctttaatgaagaatacgttgctggctggaaaaaaggccatttacaaataagtgccacatgctttgcgaagcttgatggataaaaaaagaatgtgtcaaaagtttggtaatgcttacaggataagctgacctgcttttgacacacttgttttcatgaacaaaagttatgcctgcttttcggacttacctgtaaaatcataaggaaggattttcgctcttaaaagattattttgttcttcggagtaatcatactttcgggagtgtccttgatgtataggtctttctcgctgggaagttcgggacatttatgccctcatgccctcactgcatgtataataggtttattataaaagatttagatggtgagggtaaaaaatattgctctcacttatgctcttatgccctcactgtattgtgaagctgaattttgcataaaatgcttgaatacagttatatatatactttttataggatattccgttttgatgtaaagtaggctatttttaggctttctttcttgtaagaagtgcgcatggaggatttgtacctttatggaatatggcggattccggctgtggtaaaaaagatcaggtcatttttaaaaaagatgacgagctttttttaaaaggccgccgtcttttttaaaaacgtcttggtcttttttttaaatgtccttgtcttttggactggcggttggcatgcttgctgacgtggtttctgttggggtcattgtcatcaataaggcatgtgtgtgatatataaagatttgttgcaaatgcttgtagaccctctttctaattttttatttgtattattcgcttgaaaaaaacaatggtactgctgtttcagaacgggtgcaggttagtgaagcctgttggcacagttcggggttgctcctacggaattcaagcgtatgaaaactgtaaattagtgtagaactttgttctttacgaattttttcctatcttgtaccctctaatgttagaatagatgaaacagatcttcattctttttttgctatggtttggtttgtcactatcggcgcaagatcagatctctttgttgtttgtcggtgatttgatgcaacatcaggctcaaattgatgcagccaggcaaggagacgggtataattataatgattgcttccgtcatgtgaagaaagaaataagtgaggcggatatggctatagggaacttagaggtgacattgggaggaaagccttatagagggtatccggcgttcagtgctccggacgaatatcttcatgctataaaggaagccggatttgatgtattgctgaccgctaacaatcattgtctggataaggggaagttggggttggaacgtactattctgatgctggattctttgaaaatacatcatgctggaacctataggaacccggaagaacgtcataagagctacccgttattgattgagaagaatggttttagaattgtattgttgaactatacttatggaacgaatggcttgaagactgatgctccgaatgtggtgaattatattaatcgggaacaaataaaaaaagatattcttgatgcacgcagaaaacttcctgatgttattatagcctgtatgcattggggagtggaatattgttcgttccctgaacgatcggagtgtgaattggctaactggttgattgaacaaggagttgatcatgtaataggttcgcatccgcatgtactccagcctatggaaattgtaaaagacccccggactcctgcccggcatgtcattgtttattcattaggtaattttatctcaaatatgtcgaaagaaaaaacggatggaggagctatggtaagattgaagttgcaacggatttttcgaataacccgtttagcggattgtgaatatgcattggtttggacttcaagacctgttttaagtaaaaaaaagaactttgaattatatcctgttacttttattaataaatccattaataatgaggaacttaatgtgatgaaacgtttcttgaaaggaactgaaaatttattaggaaaatcgaatggaggcataaaagagtatttttttgaataatttttcctcaaaaagtttgcagatataaaaaaaagcagtacctttgcatcgctttcgaaaggaaagcctaacatggtgactatagttcagtcggttagagcgtcagattgtggttctgaatgtcgtgggttcgaatcccactagtcaccccttcacctatgaaaggttctgtaaatctaatgatttatagaacctttttcagtttttatgtctattagtgtattatcatgatgataaatttgaaagataatagcgaaaaggataagtatatcttggagttgttccagacatctcctaaggaggcttttcgtttattatttgatgcttatcacatgaaattatgtatatatgcggtgcagctgaccgattcttttgagatggctgaagatattgtgcaggatttctttatctatttttgggagaagaaatattatttgaaaataaatcagaatcttcgttattatctttatttgtctgtgcggaatgcggccatcaatgctttgcagaaaaacaacatgttgtctatggaagaactctcaggcattgatatgggtattcctgaagagtctatagatgaagaggagcaagaggaacgaaataagttattattggaaaaactacaaaaattacctcatcaggaattacaagtggtgagagctgtcattatggaaaataagaaatataaagaagctgctgaggaacttcatatttctgtgaataccctaaaaactcatctgacaagagcattgaaacaattaagaaaagaatacaatctgcactcactgttttactaaaattaaatttttcttctttttctgtcacccatttattaatttggactctcttttattaaaagaaagtaatcaatgaacaaagagaatccaaaaaagaacaaaaagtcttttgaatattatatagcgcagcgaaaagaagaatttcgttgtcaatatgatcatgaacgttcatgggaaaacctgcaatataagcttcaaaaaagaaagaatcaccgtctcagtttatattgtgtagcagcctcggcagcttttctttttcttattttaggagtcagtcacatattctctcttcacaataacacacaaaacaaggaggccgtagtggctgctgtggtttcatttccggaaacaggcagccgcaaggctatccttactttagagaatggagaaaaagtggatctgtctgttaaaaagggtacgatttctaatgcaaattctactgtaatcaataataatgccaatcaattattgacttatagaaaagtggaagaggtttcttcaactcctcagattaatacattggctattccaagaggaggggaatatcagttgattttatcggatggaacaaggatatggatgaatgctgaaagtcttttgcgttatccaacttctttcattggagaaaaaagagaagttttcctagaaggggaagctttttttgaagtggcgaaagatgctaagcacccctttatagttcatacaaacagacattcggtggaggtacttggtacaagttttaatatatctgcttatcctgattataaggtatatacgactcttgcagaagggcgtatcaaagtaagtacaactaaagtttcggttgtgttaaatcctgaccaacaagcggttattgaaccgaataatgatgatatagtgacacgtgatgtgcctgcttatctatttacttcctgggcgaaaggaaattatgagtttcgtaatacgtctttgtctgaaattgttgcccaactgtcacggtggtataatgtagatatctattttaaaaatgaatctttgaaagataaaagatttgcaggtatcattttcagggatgaagagttgaattttgctattgaagtgattgagagagtgtctaatgtacattttactcgcgaagaagaaacgatttacattgaagatagtagagaaaagtgagttataacaaataatatatttattaaattaatcaacaaacattatgagtgcaaaactttcgagcaaaaatttttacggcggaaatctcatggttaaatgctttgttgcattggtcatattcttttgttcagtgggaaatctgtttgctcaaactgagacgaaggtaactatcaatgtagataaagtgttgatcagaacagcgttggaacggttacaaaaagaaacaaaggtccatttcgtttatgatgaagaaaacatagatcaggataaaagagtgagtttgtcttatactcaggctcctcttaaaatagttctagaagatttttgtaaacaaacatcgttacgttatgaagtgaaaagaaacttgatcctgattttgccgggaaaggctgacaggaatgtaaatcgtcagtcttttttaatgaagggtgtcgttacggatgaggatggagaaagtataattggggctacagttatgattggtggaactagtaaaggtactgttaccgatataaatgggcaatatacattggaagtccagtctggggatttagtttcatttacttttgtggggatgactgataaagttataaaagcacaggtaaataaaaagatggttaatgttcagcttgagagtaatgcaactgctttagcagatgttgtgattactggatatcagaccttatcaaaagaacgcgcaacaggttcatttgataaagtagattccagtgtgttatcatcacgtccgacagcagatctttctacggcattacaaggtttggttgctggaatgcaggcgacggaaaaagaggatggaagcattgattttttaattcgtggttcaagttcattatatgctgataaaaagccattgcttgtagtggatggttttcctattcagggggattttagtagtataaatccgaatgatgtggaaagtgttacagttttgaaagatgcggctgctgcatcaatttggggagctcgttccgctaatggggttattgttgttacgaccaaaaaaggtaaaaaggataaagttcaagttgatgtacaggcatttgttcgtataggtactaatcctgatcttgaatatattatgaatcaggcagatagccgtacaatggttgattatgaaatgagagcgtttgagaataactggaagatggcagcttgggaatatgctccaattttttcaaaaatacagaattctctaactttggcacaagagttatattatgctaataaatatcaagggctttctaaagaagaaatggagcagggattagagcgtttacgtaatactagtaatcgtcaacaattgaaagattatttaatgcaaacacagttattgcaacaatataatgtcagtatatctggaggaactgaacgtatgtcaaattatatgtctttaatgtatgagaaaaatgatgaaagtactattaaacgtggatatgagaagttcatgattaactataataattcatataaggttacaaaatggttgactgctaatttgataacaaccttgcaacgtaaggatcaagaaacgtctggcgtgactattggtgaattcagtaatttgtcaccttatgaaatgttattgaatgaagatggtagttatgcaactaatttgaatgtatataatcgtgcggaattagaaaaattgcctttagaaaaattaccttatagtgattggtcatacaatatgcttcgtgaagtgcgtgggcgtgaatataagactacaaatacaatgtatcgtgttcagctggggttaaatgctcaaattattaagggactgaattatgatatgcgtgtgcagtatgaatcgacatcttcagaatataaaaattatgatagcgaagatactttttatgcgcgtaatttagtaaactcatatacggaatataataatgaaacacaggaagtaggggtttctcgtattcctaaaggtggggtcttgcgatcaggtaagacggaatattcaaattatgtatttagaaaccaattgaattataacaattcatttgcagaaaaacatgaaatttctgcattagctggtattgaaataagccaatatgataccgaaggtactgttaatccgtatgtgtatggatataataaagagaaaaatacatcatctgttcctccttatgggtatggtagtaatgtagactcattcaagaatttttttggaaatagtgcaacaattgagggtggaaatacaagttatagtcttcgttgtgacagatatgtatcctattatactaatatagggtatgtatatgacggaaaatatggagcttctttcagtgctcgtggtgatggatctaattttgtttcggatgacccgtctttgcgttggtcgcctatgtggtctgttggcgcaaaatggaatataggtaaagaagagtttataaaagatatagattggattaactatttaaatttacgtgctacttatggaataaatggtaatgcggaaaaaagtacctcgccgttgacattggtttctgttggaagttcggttaattctactacaggtactattactggaaatatctctagctttggtaatccatctttgcgttgggagaaaacttatactacaaatataggtgttgattttgacttgtttagaagtaaattatccggtaagttggatttttataatcggaaaagtaaggatgttatcggacaggttactattccgtctgtatatggtactagtactcagaaatttaataatgctgaaatattaaatcgaggtgttgaattagagttgacaggaaacttccatataccatcggtagatttggggattcgttccactgtgacttatgcttataactacaataagattttaaagctttattatccggctctttattgttatgaattagtagaagcagatactcatgtcgaaggaagaccagtcggtagtttgtattcatatgattttttgggaacggaaaatggaataccttatgttattggggctaatggagataaaatatccatgaatgatgtttctgtacataatcgttctttgggacttgatatcttgcattatagtggtactactattcctccccacacatttggatggtctaatcagtttacttggaataatttcagtttatatgtttatttaacaggtaattttggtggtatctttcgagcgcctactgccggaagtattccttctgtaggtagcggaaaaacttttgtcagtagttctattaaggattttgctgatagtgatggtactctatatcctacttggcctcttaaagatgaatctaatttttatttatgggatcgttatactccgaatttagaatattttgttcaagatgcttcttttattcgtttgaaagaaatcaatttagaatataatttgtctaaaaaacttgctggaaaattacatcttaggggggcgaaactttttgttcaagcacgtaatttaggattgatttattgtgctaatgattatgggtatgatcctgaatggctacctggaagtaataaaccatctgcaacaattgcctttggcgctaatattaatttttaatttaaagattatgaaacaaataatatatgtttttttgttgactgtattgtcttcgtgtgatagttatctgtctaaagtgccttcgccttctactagtgctcctattaataacgtggaacaactggttgcaatttatgataatgcaacagcatttattaatgaaaccaatccctttgcttgttattccaatgatgatgccgacttgacagccgaattatataaagctgatcctagtgcatttgctatatcaagtacggttttttataatatattgcatacagcagggattgcttcacaggcttcggatggtttatggaatggagagtattcaaatatttttaaagctaataccataattaacaatgtggataaagttactggagatgaaagcgagaaaataaaattaaaatgtaatgcccattttttacgtgcttattcgtatttcgtattagctcaatattattgcttgccttattgtgaagccaataaaaatgctttgggacttcccaaacgtttgaatacggattttgaggagtcaatagccagggtgtcattggacgaaatttatcaattgatattagatgatttggaaattgcagccgtgaccccagataagagtgtaaatcctaattttccatggcgtatttgtcaggcaacagtaaatgcattactttcacgtgtatacttgacaatggggaattataaggaggcacaagctactgcggaaaaggctttggaaggagctcctgaactattggattttaatgaattgggttatgctcctgttgaatcttatccagaaatggagggtcttccggcacaggatgtatataattgtgaaactcataaatggacaacgattaagtatttatattggaaggaatttcttttcccacgttttacttatgcgcgtagtcaatggattattccatctgatgatttagtgagtctatatgatcagcagaatgaccgccgttttaagttgttttttgtggaacatggaaaccgtcgtatgggagttccgtatgaagcatatcgttataatcaattctatgatggacgttatataatatctggcttgactactgctgaaatgttattaaataaagcagaggcacaaattcgccaaggaatgtggcaagagggtttaaagactttggacgtgcttcgtgaaaagcgttatgaggccggtacctacatttctcttagcgcaggtaaccaaagtgaagctttatctattgtattggctgaaagacgtcgtgaaatgccattttctatgcgtatacctgatatcaaacgttatggtgtaaatgaaatattggaagatgatgtgacagtagtaaagaatttttttgaaatatcaatgtctgaggtttttatagataagcctaaaacttatacgattccttccaatagtttgttgtgggcgatgccaataaatgatgttgaaatagggtcaagcaatggtgctattcaacaaaatagatatgaatgaacaaccttaaatagtgcaaatcttcaatgattttttgagatgctacgtttggggtatatgtagtatgtttttgacaaaatgatatgttattaattacattataataattggcgatatgagaaaaaatattttttttatagtattcattattttatgtgcagtttcgtgtacagaaaaaaaatcaaattttattaatacggttcatttgaaaggccagttgtttgatatgggtagccagaatgtgcgtatgagatttgacggagcagcatctatgctaggtgacagccgagatattttgttgaaaacggatgctgccggttattttgatactacttttgtacttaaagagccgacatattatactatcagccgcaacacattgtatcttactccaggagatgacatgactatcaaagtaactcagacaaatacagaagcggaattctcgggaatcggagccgaagccaataattacatgaagttccgtctttttccgaaaggtggttcttatctggaagccggtggtaacttgcgtggagattttgtgtccactaaagcgttggttgacagcttggccgctatacgtatgcatacattggatacgttgagtaatgtgtctgatgcatttaaaaagctggaaacagcacggatcaaagcggatattatcaatagttatatctgttatgcaagttattcaaggatgtttgccgaagtgaagaatgaagaagagatgcgggctaaatggaatgagtttaatgtttcattaactcaggatgtaactccgctatataaggagattgtgaatgaagatatgctgaatgtagctgtggtgcgcgatgttttgtcttatcaggaagattctacattggcttctctttggtttaaggatatttccattcctgcgcgtactacggaattatatgcttgtgctaaaatagtcgataatctgagaaatgaagcttcagaacagactgtgaacgaggcgaaggcatttttgcaaacagtgaagaatgctgattttgcaacagaaattgaaggaaagattgttcaagcttccaagttgcttcccggacaacctgccattgattttgaaatgttggatgtggagggtaatgtgaagcatcttgcagattttaagggtaaggtgatttatattgatttatgggcgacctggtgtgggccttgcattcaggaatctccggcatttgaggctttaggtaagaaatatgtgggtaaggatatcgtttttcttccggtttctacagatactacaacgaaaccttggttaaggtatttggatggacataagaaagaattgactcaatatcattccaatgatgttgctttaaaagaaagttgggctatcatgtatattcctcgttttattttgattgacaaggatttcaatattgtgaatgcatacgctccacgtccgtcaagtgaagagattggtactttgattgattctgttcttaataaatagtaaatttatgatttataaaaaatatctattattaggcgtttctttatgcatgttaaatgcttgcaatgagtctaagtctgtgtctttagagggtagtcttgatggaatccaggctgattctatctatttatatcaagtagacaatgagcattatggtagtgtgaaactgattaaatctattgctgttaccgatggtaggtttgcttatcccactgattctatacaagccggtctttattgtttctctttgcagaatatggagcgtggagagtatttacagcaatacgctaatttgtttttggaacccaaatccatgcagcttaccttgggtaaggataagtatgatcaactgagtttacatgctacagggtctgcattgcaggagcaatacgaagccttgcaagaagcgaaatatgtagcaggtaatcgtatggttctcgattctttggatcatatgttctatgaagctcgtgaaaaaggggatcgtgaggaaatggagcgtatccgggaggtttccagtccttattatgagagtgcctcggaacagacccgtaaactgataaatggggaaattgctaaaaataaaggctcatacttcggtttgtatctttattatacttatcgcttccaaaatcatacttttaatacagttgaggagattgatgaggcacgtaacttcataggcagttttgatgaggcgtccaggcgaagtggtatatatgtaaaaatgcaagaaggtttggataaatttgctaggtgtgctaccggtagcgttgctcctgctataacaggaattgatttgaaagggaattctgtcagtttgaacgatttcaagggtaaatatgttctagtcgatttctggtttgccggttgtagttggtgtcgtaaggaaactccttatctgttgaagacgtacaatgctttcaaagataaaggatttactatttatggtgtgtctacagaccgtcgtgaggaagattggaaaaaggctattgaagaagacaagagctattggaatcaggttctgttgcagaaagacgacgtgaaggatgtgttggaatcatactgtattgtcggtttcccacatataattttagtagatccggaaggtaaaattgtagcgaaggagttgcgtggagatgatctttataataccgtcgaaaagtttgtaaacggagcaaaataaagaaatgtgttttttaactcataaagcagtaggctgggaatgtccggtctactgttttttcttttatggaatatggtttttttttgaaggaatgatatggttttattataggtagtgatgttctgtattgtatttattttttaaataaatctaatgtgtgacctgtatttctttaatgttttccttttgaagaacatattgtctgtcggataagttaaaagtttacctttgcaatataatcagaggatgagatattgatctataataaatattataaataaaacgcataggtattgtaagcgtacaatactttttggtggtctcgttggatgcttgtgttcagatttaaggcgaggtcaccttattctcgtagagaatttagattttaatttgaatgatacttgctcgcgatgagtaggtatcatttgttttttagtctattctgtatggaaatggcttgtaagattatacatagaagatagaataattagatcactctgccgttgaaatggaggatttgagcggattattttaattattggaagaattgttctatcctttaaagcatattgcttctatctttgccatactgagaaaaacattaaattacactattatgaagaattttcttatcttatctctgttgttagcctttttgactacggaagtatgtgcgcagtggaaaccggctggtgacaagatcaaaacacagtgggcaaataaaataaatacctctgccgtattgcctgaatatccacgtcctataatggaacgtaatgaatggaagaacttgaatggtttgtgggagtatgctatcaccgatttgggaggaaatgttccggcgcattttgacgggcagattttggtaccttttgcagtggaatcttctttatcaggtgtgggacaaagagtcggtgcaaaaaaggaattatggtattcccgttcatttgaagtgcctgttgcttggaaaaataaaaatgtattacttcatttcggtgctgtggactggaaagcagatatttgggtaaatgatgtgaaggttggtagtcatactggtggttttactccgttttcttttgatatcactgcagcgttgtctggtaagggaaataataaattagtagtaaaagtttgggaccctacggatgaagggtatcagcctagaggtaaacaggtgaataatccggagggtatttggtatactcctgtgactggcatttggcagactgtttggctggaaccggttactgccagacatattgaagaacttcgaatcacaccggatattgaccaacacttactgactgtaaaagcccatttgaatatgagggcaccttccgatctgattgaagtaaacgtatatgacggcaatcagttggttgccactgggaaaagtattaatgatgaggctgtggtcatacctatgccggaagatgctaaattatggagtcctgattttccctttttgtatactttaaaggttatgttgaaaagcgataataaaatattggatcaggtgaacagttatgcagctatgcgcaaatactctacgaaacgtgatgctaatggaattgtacgtttagaactgaataaccaacctttgttccagttcggaccattggatcagggatggtggcctgatggattgtataccgctcctactgatgaggctttagtatatgatatacaaaagactaaatacttaggattcaatatgatacgtaaacatattaaagtggaaccggcccgttggtatactcattgtgatcaattgggaattattgtgtggcaggatatgcctagcggtgatcgtaatccggagtggcagaaccgcaaatattttgaaggtacggaaaaaaagcgttcggcggtttctgaggcttgttaccgtaaagaatggaaagaaattatggattgcttgtattcttatccatgtatcggaacatgggttccgttcaatgaggcatgggggcaattcaagactccggaaattgcagaatggactaaagaatatgatccgacccgtctggtaaatcctgcaagtggaggtaaccattatacttgtggcgatatgcttgacttgcataattatcctgctcccgaaatgtatctgtatgatgcccagcgagctaatgttttgggagagtatggtggtatcggttgggtagtgaaaaatcatatttgggaaccggatcgtaactggggatatatacagtttaattcttccaaagaagtaactgatgagtatataaaatatacagatatgctttatgacctgataatcaggggattctcggcggctgtttatactcagactacggatgtggaggtggaagtgaacggactgatgacttatgatcgtaaggtgattaaagtagatgaaaaacgagtgagagaagccaacgcacgtgtctgtaaatcattaaagtaaggaatatgaataagctgttcttttgggtatgtgcagtccttatgactgcatgtgcttcttataaaaatgatgaggtcttgactgaatccggtttaagtaacagtcgttttcaaacggagataaatggtgagaaaactgatctgtttgtattgaagaataaaaataagatggaagtttgtatcaccaactatggcggtcgtattgtttctgttatggttcctgataaagatggaataatgagggatgtagtattgggttttgattccatacaggactatatcaaatatccgtcggattttggagcaagtatagggcgttatgccaaccgtataaatcagggacgtttttcattggatgggatagtataccaattgcctcgaaacaattacggacattgtttgcatggaggtcctcaaggatttcaatatcgtatttatagaggtattcaagtgagtgacagagaggtgaaactgacttacttgtctaaaaatggtgaagagggttttcctggaaatttgaattgtactattataatgaaattgacggacgataatgctattgatattcagtatgaagcagaaacggataaaccgactgttgtaaacatgactaatcattcttattttaatttagatggagatccgtcaaaagataattctgattatttattgactttgaacgcggattattatactcctgttgacagtacttttatgacgactggagaaattgttccggttgagggtactcctatggatttcagacttcctgctgtcattggaactcgtattaatcaagattttgaacaattaagatatgggaatggcattgatcataattgggtattgaatactaagggggatattcatcaagtttgtgccacattggagtcacctgttacggggattgtactcaatgtttatactgacgagccgggtattcaggtttattgtggtaattttctagatgggacattgacgggtaaaaaaaatacaatatataattttcgggcctctgtgtgcttggaaacgcaaaaatatcccgatacacctaataaggcagactggcctacggcagtagtgagaccaggagaaaaatatcaaagtcattgtatttacaagttttcggtacataaataatgtatgttaaggtagaaggaattgtggaatataacatttgggataaataagattcagagaggaagagtcctgaaagaagcggtgagagtaaacactggttcttttgggactttttccggataattattgatatggagaatttaatctttaattttgtactctctaaactaaattgatatactatgaaaagaatattcataataggacttctttttttatatgcatttactctttactctcaaagtaatatccgatattatttcaaaacattggatattcaagacggactctcgcaaaacacggtgaacgctattttgcaagataaacaaggtttcatgtggtttggaacaaaagatggtttgaatcgttttgatggcctgagttttcgtattttcaaaaaagagaattctgctttaggaaataattttatcactgcacttcatgaggataaagaaggaaatatttgggttggaacagatgcaggcgtttatgtgtataatcctttattagaagactttacagtatttgatagagttagtgacacaggtgatatgattagtcgtgctgtgactcgtattgaaagtgatgaagatagtgatatatggatttccgtggattatcaaggattgtttcattttgatcgtgtgcaagatcggttaattaattgtctgcatagagataagcgtaagaaccaattggccaatgttacgcgtttttggtttgaggaaaaactatgttgggtcagtttatatgacgacaacctatattatacaaaagataattttaagacattgtttccctttcaggattctgaaggaaaagagccttttaaagatgatatcattaatacttggattatgggtccccataattgttggtatatcggttcttctaatggtttgactgaaattaatctgacaacagggcgggtaaggcgtttgttgaattattatgtgcgtgatttaggctttaaatcggataaggaattatgggtaggtacggagtcggggctatatatttatgatttggaaaaaggtgaaatagctcatctcactgtttcaaacgggaatgattcttatgctttagccgataatgctatttattctctatgccgtgataatgagggaggaatgtggatcggatcttattttggcggggtcaattactatccgcgtcaatggacttattttgaaaaattctaccctcgtgatgatattaaaaattttgggcgtagggtacgtgagttctgtgaaagtaatgatggtactgtttggattggtactgaagataagggattatttcatttttatccggaaagtggaaagatagaaaaattctcacatcctgctatttatcaaaatgttcatggtttatgtttggacggtgatgatttgtgggtaggcactttttccggaggtttaagccgtattgatttgcttacgaagcaagtaagacactatcaaaaagatataagcccaaattctttggatgccaataatgtattctctatttgtaaaactacatctggtgacttatggattggcactacatctggattgctgcgatataatcgtgatacagatgactttactaggatgccggaactagctaatatgtttgtttataaaatattggaggattttagtgggaatttgtggctggcaacttattctaacggtgtttttcgttatgatgtgaataagaaagaatggaagaattttatttttcacaagaacgattccacttcattaccttatgataaagtaatcagtatttgtgaagatagtcgtaagcggttatggtttatgacacaaggggcgggtttttgccgttttaatccggaaaatgaaagctttactcgttttgatatgtcgaaaggttttcctagtaatatcatttatcggatggtagaggataatcgggggaatttatggttgacaactaataatggtttggtttgtttcaatccggaaacagatgataaacgagtttatactacagcaaacggattgctaagtaaccagtttaattatcagtctgggtataaagataagatgggacgtatctatttaggtagtataaatggttttatcacttttgatccatctacttttgtagaaaatacttttgttccaccagttgtcattacagatttcttcttattcaataaacgaatgcagatcggcagtaaggattctccattgaaagaaagcatcgtcttttctgatgaggtcgagttagaatctgatcaaaattctttttcattgcatgcggcggcattaggttatcaggcaccggaaatgaatcaattggtttataaaatggaaggatttgataaagagtggtataatgtagggcggaattcggtaatcaattattccaatttaccatatggaacttatattttccatttaagaggatcgaatagtgacggaaaatggaatgaaaaagagcgtatattgaagattcatattttacctccgttttatttatcagggtgggcctattttatttatttgctattaggaattctgtctgtggtaggtatcatttattatttccggaaaaggaatgagcagaaacaccaacaggccatggagaaattcgaacgggaaaaggaacgcgaactctatactgcaaaaatagatttctttacgaatgtggcgcatgagattcgtactcctttgacattaatcaaaagtccgcttgaaaatgtgcttgtttctccgaatgtatctgcagatatccgtgatgatttggaaataatgaatctgaatactacccgtttactggatttggttaatcagttacttgatttcagaaagactgaaacacgtgggtttcaactgaattttgtagagtgtaatatttcggatatattacagcagatttatatgcggtttactccattggcacggcaaaagaaattggaatttgttattgaatgttcggaatctatctatgcgtcgatagatcgtgaggcgttgactaagataattagtaatctgtttactaatgccattaaatattctgaaacttatattcatgtccggttgtggatggaggatacttgttggttcttgtctgtctgtaacgatggcaatgtaattcctatggaaatgcgtgaagagatttttaagcctttcatacagtataaggacggattttcccgtaaggtttcgggtacgggaattggtttggcattggcaagatctttagctgagttgcatgaagggaacttaattatggatgattcacaaaagcagaattgttttattctttcattgccagtaaagcatgaacatactattgccatttcgaagagtgagattaagttgaaagaggatccgaaagaagaggatccgggacaattgcaacagaagccgcgttacactgtattgattgtggaggataatgttgaaatgttggcttttgttgtcagacaattgtcacctgtttatcaaatattgactgcaactaacggagtggaggccttaaaggtgttggaggggcatacagtgaacttaatagtatcggatataatgatgcccgaaatggatgggttggaattatgtgaccgtataaaatcagacttggattacagtcatattcctattgtactgttgacggctaagaccactttacaatcaaaaatagatggtttgaaatctggagcggatgcttatattgaaaagccgttttctgtggagtatttgaaagtgtctgttgccaatttattaagtaatcatgaaaagctgcatgcggcttttgcacattcaccgtttatacagaccaattctatggctatgacgaaagcggatgaaacttttttgaaaaccttgaatgaagtgattgttgccaatatgcaaaatccggacttctgtctggacgatatggcgagtttgctcaatatgagccgttccagtttgaaccgcaaaataaaaggagtgttggacatgacccctaatgactatatccgtttagagagattgaaaaaagctgctcaattattaagggaaggagaatgtaaggtaaatgaagtatgttatatggttggcttcaatactccttcttattttactaaatgttttcagaagcaatttggtattttaccaaaagattttgtgaaatgatttttttcggcgcatgaaatagaataatagaactaatcgccctcaggaactattctgagggcgatttttgaatgtattattctattaattggttgaatagttctagcacattcggggagtttggaatacatttgcatcacaaaaagttgagaatatgattcatgtaatactgtgaaaaaagaaatgcctatgacataacaagaatgtgacctttaaattctatctgttgtatgtatatttatgaacatacttgtgattaattaaaaagcggaactgaaatctccgcacaattttacaaatctaattctataaaaaatgattaaaaaattattagtcttctttctgactatttttacgatgactgcttatgcgcagaacgtaacaatgaccggaaccgtagtagacacagacaacttgcctttaattggtgtgaatgtggttattaagggactactactgatttggatggtaagtttactcttactggagaaaatggacaaacattggttttctcatatatagggatgaccctccaagagattgtttacaagggaaaacctttgcacgtgataatgaaggatgattccaaggctttggaagaggtggttataattggttatcagactgtgaagaaatctgatctgacgggtgcagtagcagtagttgataccaaagagatgaaaaaaagctcagctggaacacttgtcagtcagatgcaggggcttgctacaggtgtaaacgttcgtagtagtggtagagcaggtgaggatgcttctattcaaattcgtggtgtgggttcattaagtaataatgctccgttgtgggtggtcgatgggatgataactgatccgggagttgactttaatccggctgacgttgaatctattcagatcttgaaagatgcttccgctgccgctatatatggttctcgtgctgctaatggggtgattattgttactactaagaaaggggtgagtggtcctatgaaggtgaatgtgagtgtgaaagaaacattggagtggagtccgaagtttgatttgatgaatgcggcagagtacattaaatataatgatatagcttataaagaagcgataaaagatggtatagcctccataacaacaactcagaagcattccgaatatgataccaattggcaggatgaggtattgaagacagctttggtacaggattataatgtatctttatccggtggtggagattcgggtagttattttgtttcagctggttactataataatgatggtgtatcttatggaaatacgtttgatcgttatagtttccgtgttaacacacaggggaaaaaaggttggttttcattcggtgagaacttggcctactcattaactaatacagatccgaaccagacaaatacttataatgactttttacgtatgatgcctactattccggtttatgatgagaataatccaggtggttatggatatggagatgcggctaaatataatactttcggtgtaaatcccattgcacgtgaaaatttggaaaaacgccatatgagacaaaatcgtctgaatggttcattgtggttggagttcaaacctttcgagtttctttcttataagttcaatgggggcgttgacttgtatttctatgaaaattcatggtttcgtggtgaaggtaattggcaacaaaatcaggaacatcgtgatccggagagccagaaagcacgtgataatacttataatatgctgattgagcacacgttgaattttaacaaggattttggaaaacatcatgtcgatgcagtattaggtactacttaccaacatcatgagtgggaggggttatgggcttcccgtcttaattttcctatgttaggtaatggtgattatctgacagtgttaaatgctggacaaagtaaccaacagaatactaatagtattagtgagaatgccatgatctcttatttgggacgtgttaattatatttatgatgacaaatattatctgacagctactttccgtcgggatggtacttctcgtttagctaaggaaaatcgctggggtaattttccttctgtttctgctgcctggagaatttctaaggaaagtttctttaaggtaccttggattgatgatttgaagatcaggggaaattgggggcgtttgggtaatgcttctatcggtgattgggattatgttggtactattaatcaaagcattgtgacggtatttggtggagctattgtacctggagccactcaagtaaaattagtgaataccaatcttgtttgggaaaccaaagaaaccgtaaatattggttttgacgctagttttctcaattcacgtttgactttcagtgccgagtattatcattcaaagactaaggatgttttgacggaaatgcctattgccatctctaccggtaatcaagaaggggcacctaaagcaaatgcggctagtttgcgcaatcgtggatttgaattgagcttggggtggaaagatcaagtttcagatttcaaatatggtgcattgttgaatattacaactttgagtaataaagtattaagtttaggatatgaaaaaccttttattgattcaggtcaggcaagaacgaggttgaatggtccgttggcagaattttttttgtataaaaccgatgggatttttaaaacacaagaacaaatagataattatgtaactcctgatggcgaacctattatgatttccgggaaacgtccgcaattaggtgatgtgaaatatattgatacggataataatggacagattacggcggatgaccgtcaattttgcggaagtccgtgggcaaagatgcaaatgtcattggtcttgaatgctgaatggaaagactttgatttcagtatgatgtggaatgggcaatttggtaataaaatttataatgtatccaaatggcaaggacgtttgttctcggacaattccaattatcttcgcttcaagaagggagaagaaccttatcaggtaaatcagaattctgatacgccacgtataatttatggtgaccaacgtaattcatgggatgcggatcgtttccttgaaaacggttcttatttcagactgaaaaatatttctatcggatacaatcttaaaaaggaatggttgaagaatttgggtattgacaaacttcgtttatatgctaccggtagtaatctgctcacttttacaggctattccgggcttgatcctgattttataaacactaatatttggaatagtggaacggatagtttttcatatcctaatactcgttctgttatgtttggcttggatttgaccttttaacttataaattagtatactgatatgaagaaaatatatagatttttatttgctggtgtcttggctttgtgtgctaccggatgcagctcaagtttattggatatagaaaatccgaatgaagtaaccaatactactttttggaaatcggcggatgatgcaaaagctggagtaaatgcttgttacagtttcttatataaagaagggacttggatgcgttggttgtcttttcgttacgatctgtcatcagatgaaggatggagttcgtctccttggatagaattaggtgactggacgcgttttctttataataattatgatttctatgagggtaataaggtacattgggagcatttttatgtagggatctttcgttgtaatcaggttttggctaatgtgcctgcgattgaaatggatgaggttcaaaagaaccaacttttagcacaggcttcctttttacgtgctctgtggtattttcagataaatcttttgtgggagaaagggacattagttcttgaacctcaaaatgctgattacatacctaaggacgcttcagaacaggaaatttgggatcagatagaaaaagaccttacgtttgcaatggagaatttgccggaggcatgggatgcggcagatttaggcagagcgacaaaaggtgctgctaaagctttgttgggcaaggcttatatgcaacaacataaatatgatagggccaaagaacagttgcaatggctgattgatagggaaggctctttgtatggtttgcttgataaccgtgaagacaattttaccgatttgaatgaaaataatcaggagggaatatttgaaattcagtttgatgatcaaaataaggggggcacaggcaatgatgccagtatggcctttggtttccagcgtactcagttttatgcacccggtggcactcatggtacgggttggggcgatggtaaagcgcgtcgttggctagtagatgagttcttgaaagagagaagggttgatggcagaaatgacttgcgtttatacaatagtattctttataaacattttggagatgattttcctgatcagtcaaaaaaatactatgccaatgaagatgcgtcacaatggtttgatgagtggggacaggacacagaggattgttatattcgcaaatacaatacttcttactatcgtgaacgtgaagactatttcgcacgtaataattatcgtattatgcggtatgctgatgttttattgagttatgcggagtgtttggttgaaactggaacttcggcttctgatgcggctgtttatgttgataaggtaagagaacgtgcagggttatccaaactgaaagatagtcggtggaaggattgtttaagttcaaaggaggtctttatcaaacgtcttcagatggaacgtgctttggaactttgtttcgaaggctggcgttgggcggatttgaagcgctggggattgcttgattcacaggctggtattgacgagctgaaagctcgtgacaaggacttcaacaattttgtgattggcaaacacaaacgtatgcctatccctacatcggaagttgaaatcagtaagattgatgatgttcctcaactaactcagaatcctaattattaataaaaaagaaagactgtgtcggagtgttttttctttttataatacttccggcatagtctttatttaactagtatcatttatgcttgtctgcaaaaaaatactgatcttctgtgcttttgcttgttgcggtactttattcgcgcaaaacatacagaatccggtgcttcccggagtagcggatgccggtgtgatgaaatataatggtaagtattatataggtggagtatttaccaatggggatttttatgtttccgacgacttggttcattggggtaaacctgttcatgtcgtgactatggataatggctggagtaaaggaagtggtgccggtaatgagcagattcacgccaatgatatgttttgtttgaatggtgattttcacttatattggtctgtcaattattggggtaaggataagcatgctgttcacattgtacatgctcaaagtaaaaatgtgttggggccctatatagagcctgataaaaaaacttggatggataatcgcattgatcctaaggtttttaaagatgatgacggacaattatatatgtatatggtgcgttttactgatggaaatactatttggggacgtaaaatgaagaatccggcggaatttgccggagaaccagtgtgcttgtttgcatcattgccggatacatgggagaccatggataacagagtggcagagggaccttgggtgatgaaatacagagaccgatactatttgatgtataatgccaatcatacctctactgagtgggggaattatcaattgggggttgcggaggcagactcacctttaagttttcaaaatgggaataaatatagctatccggtagtaaattctaatcaaattctactggaagagaattatgtggatcttttacgatatggcatcacttatgagccattgtttgattatacagaaaataatcctggagtcggttggatgcttccggtatatcaggcttccgattggaagaaaggagaatgtggattctcatctaaagagataaaaggatctaccactcgtcatttaggtacttggtggacatctccttcattgtggttacgtaaatctttttttgttggcaaacaggtgggaaatttagcactcagggttgctcatgacggagatacaaaaatatatttgaatggaacattgatttacgaaaaacagggacgggattattgtatggtaaaccttgatgaaaagcaacgagagcttctgaaaaaaggagagaacttgcttgctgtagaaacaaataaagggcgtgcccaattttttgatgtttctttgtttgatatgaggagtgaaacagcggatgatattttgatgaccccaggacaacctaatattttaagggggcccaatggatttgaatggtggcttatatatatggctaataaaaataatgagtgtagggggcagtatattaaccgtgttcatttctttaataaaacattatttgttgaaggaataaccggtccttgtacagatggctatcatccggaaccttctttgcccactttttcaatgaaaggggaaacaccttcttttggagtgctgcaacaagtgaaaccttctacaacttatatgtttgaaacagcagtcaaaacagatggagatgctggtatcattgcgtggtggaaagatgtggataataatgcttatatcggtttcgatacaaagaaccacaattggtatttgcgtaccattattaatggtaaagaaaaggaggaatatttcactttgcctaaagattttcgttggggtgtttatcatcatttacgtattgaacgtaatcaggattgtttaaaagtatggttggatgaaataccatctcctcaaaaacatctgtttacaaagattattcctgtgacggaacccggtgttcccggagtgtttgatcggactaaaaaagctttgttcgaaggggtgacttatactatcggatttgatgatgaccggatacagttaaaagaacattcagaaatattgaaaggtgattttcttgatcattatgaatttagttttcaactttcaggtttgtccgattgtaagatgtcaggaagctatccggtttatgtggataaagataactatgtaaaagctcaatttaatggtatcacgcgtatgctggaagtggtagttgtaaaacaaggacaacagatacttgataaaaaatatccgttggaacatttacaaatggtttatcctgatgtgaagtatactgattttgtcgaaaaatgttatcgttttatatcgccttcatggataaatgccctttacctgaaccgtcatgaagtagggaataaggcggagtttgtagacgatatgtttagtaaatttacaatagaatatttgaatgagggaaaatggtatccattgaataacagcggggcgacggtggcagagcatctggcttataatcgtttgtcttttactccgataaaaacggaaggtattcgttttattaataaagacgctcaggatttggaacggcatatttataagttgggaattcaagaacaattaaaggaatcttataatttccgtgcggtgagaaggggaaataagctctatctttttgttgacggaagagaattagggagattggatattcattatcctgcttcttgtgtaggattttgttctggaaattattctccggtatataaaggaatattgtattatcatataggaaactgactagtattatgaaaaaaaaatgatttttatttggttattgatgttggggacattgacttcttgtcagtcatgttcctcagaatataagaatgtgaatgaaataattgtggaagagctggaaatacctgttccactgggtgacccgtttatattgttgcacaatgggacttattatgcttatggtactcactcggatgaaggaatagaggtttatatctcggataatttaaaaacgtggaaatataaagggctggctttgaataagaaggattcatgggcagaccgttggttttgggcaccggaagtatatgaagtgaatggtaaattttatatgtattattcggcagatgagcatatttgtgtagcagtggcagattcccctgtaggaccatttatacaaaataagcaagaacctatgattgttgaggagaaatgtattgataattcttttttcatggatgatgacggtactccttatttgtcatttgtccgttttaatgatgggaataatgtatggatagccgagttggaaaaagatttgataacccttaagaaagaaacgatgcgtccttgtattcatgtttcacaggcttgggaggaagtgtggcctcgagtcaatgaaggttcttatattctcaaacacaatggaatttattatatgacttattctgcgaatagttatgaaagtccattctatggtgtaggttgtgctacagctaccgatataatgggggaatgggctaaatacgacgaaaatccattattgcaaaatcctggtgggttggtaggtgtagggcatagcgccatgttcactgataaagagggaaaacttcgtattgtattccatgcccacaaagataaaagtaatattcatccgcgtgctatgtatattggtacggtaaattttgagaatgtgaatggaacagaccgtatgagaatcattaaagaatatataactcctaaattactgcaatgagaaaaaatttgatcctgtctatctgcttttgtttggtgtcttgctcatcatcgtctgcgcaagaagaaatacctgatggtgataaaaccagctattactggaatccggtgatagattatagtctgcccgatcctactattatagaaggtggtgatggttattattatttgtatgcaaccgaagatattcgtaatttgccgatccatcgttccaaggatttgattaattgggaatgggtaggtacagcattcacggatcgaacgcgtcctgattttgaaccgggtggaggcttatgggctccggatatcaataagataggtgatacgtatgtactttattattctatgtctaaatggggaggtgagtggacctgtggtatcggttgcgctacggcagacaaactttcggggccatttaaagaccatggtctgatgtttcggagtaacgagattaatgtacagaattctattgaccctttctatatagaagatgccggaaagaaatttttgttttggggcagctttcggggcatttatggcattgaattaagtgaggacggtctttcaataaaacaagggaagaagcctcggcaggtggctggtacagcttatgaaggaacttatattcataaaaaagaaggtttttactatttttttgcttccatagggacttgctgtgaaggattgaatagcacttacactactgtagttgctcgttcagaaaatttgtttggaccttatgttgataagaacgggaggacaatgatggataaccaacatgaagtgttgattcataagaatagttcgtttgtgggaacaggacacaattcggagattgtgactgataaagtgggtaatgattgggtattttatcatgcagtggccacaaagcatcctgaagggcgtgttttgatgatggataaaataagttggaaagacggatggcctgtggtagctacggattctccctcattgaaatcggaaaaacctgtattgtaattaataaatacataaaaatatgaattggaaaaactttgtatgtagtgtggtgtgtctggcaggaatgacttgtgcggaagctgtgaactatacaccggaaaatgtttcggcttccattgctttgaaagtgcctggtaatgatgcgaagcggtatccgctgactttgcagcaattggataatagtaattttgaatatcagtgggtggcggccgataaattacctgtggtgatttatcagaatgttgaagaaaaagacggcaaccagcgtattgtcatttttatgactgcattggatgatgtttatttcaattttggtgagcaggtaatgactggttgtcatcatgatgattgtttgttttatatgcctggattttggtatcgtcgtaacttgcgttctcctcaagaagcgccgtcttttcatacctcggatagctggttggttcgtgaagaccgtttaagtactcccttgactgctatttttgatgaaaagaataggaaaacatattctgttatccggctggataatatggcttcggatgctttgactacccataaggaaggggaagtgatattgtctggtaaaacctctataggttatacaggatttgaaaacctctcgggtatcgcttctttgtcttttgggtttccttacaaggaagctcctaaaacttatattcgtaaattgacattggctccttcggttgaggcctatcaattattacgtaaaggtgagagtctttctctgacttgggaattacatgagtcggaaattgctgatttttcagaatgtgtgcagcatatttgggaatattcttatgatacaaactgtcctcaaattgtaaatacaccttattctcctgagaaaatgaaggaagtgatgagtaatttcttcgtggaaagttttgtcggaaatactcctactcattattattcgggggtggaattgcgtacagctacttgtgaccaaacggatgttgccgaagtgggttttgtgggacgtactttgttgaatgcttttaatgcattggaatatggagaacagcagcgtcgtacggatttggtgacgaatgcttataaaatttttgattcttatttgcagaatggattttcggaaacgggtttctttaatgaagtagtacattataggcgtaattttgtagagtctgttcatagtatccgccgtcagtctgaaggggtatatgccctgcttcattttttgaattacgaaagactgcaaggtcgtaaacatcctgagtgggaaaagcgtataaaaagtatgttggatatgtttctgcgtttacaaaataaggacggtagttttcctcgtaagtttaaagatgacttttctattgtagacaagagtgggggaagtaccccttcggcaactttgccattggttatgggatataaatattttaaggataaacggtatttggcaagtgcaaaacatacggtggagtatttggaaaaggaattgatttcgaagtccgattatttttcttctactttggatgctaattgcgaggataaagaggcatctttgtatgcgtcaactgccgcttactatttggctttagctacaaaaggagctgaacgagcccattatgctgggttggcgaggaaggcagcttattttgcattgtcatggtactatacatgggatgtcccttttgcccccggtcagatgttgggtgatttagggttgaaaactagaggctggggaaatgtttctgtagaaaataaccatattgatgtctttatctttgatttcgctgacgtattgaactggttggcaaaagaatataatgaaaagcgtttttcggatttttctcaggtaatcagtacatcaatgcgtcagttgttaccctatgaagggcatcgatgtggtattgccaaaacaggatattatccggaggttgtccagcatactaactgggactacggtaagaatggtaaaggctattataatgatatttttgctccgggatggacagtggcttcattgtgggaattattttctccgggacgtgccgagaagttcttgaaaaaatagtttgaaaattgataatttattatgatgttaagtgattagcatttcatttaaaacttgattttcttttcttttgtagggaaaggtatgtcctttttcagaaaatcagctttctctttaaggaaggatacctgaagtatattaaaaagccggggattgtctttacagatgttcccggcataattttttaccgtcactggcattattgttctgactttacatctcttattgaataaaacaagtaaaagaaagaatttctctatgttaagataacagtttactttaaattcttaactttgttccccttgaaaaatgattgttacaagataatttaacagctaaaaatgcaacaatataaaagaccggaagctataaaacgtatgaatgagctggcgggtagccggaagcctttcctttttattatagattataaacagcagtgttccttgatagaggaaataagtcggattgattctacccgttgccgttataactttaatggagtgaaaaatgtggatactgtaacagaaagttacagtgggcggatagactggaactttgttccaatgtctttggcagactatcggcaggcttttgaaatcgtaaaacggaatattctggcaggtaacagctatctcgctaatttgacttgcaaggttcctgtcagtactaatcttactttggaggatgtgttccggtactccaaagcgctttatagactttggttgaaagataaactggtctgtttctcacccgaaatttttgttcgtatagaagatggcgagataaaatctttccccatgaaaggaacgattgacgctaccttacctaatgcggaaaaactgttgatggatgatcctaaggaaactgccgaacatgctaccattgtagatctgattcgtaatgatttgagtatggtggcggaacaggtcagggttgtccgctatcgttattgtgaccggcttgaaaccaataagggacctatctttcagacaagctccgaaatatgtggtgtcttgcccgatgattacccatcgcatataggagatattatatttcgtttgttaccagccggttccataaccggagcgcccaaatccaagacgatggatattattgaagaagcggaaaattatgagcgtggattttatacgggcataatgggttattgtgatggcaggactttagacagtgcggtgatgatccgttttttagaacaggaaggagagaatctttattataaggcggggggaggaattacttcaaagagtgatttacaaagtgaatataatgaaatgatacagaagatttatgtacccatttattgaaactatacggatagaacaaggaaaagcgtgtaatttgtcttatcataatgaaagactgaacaatacccttcatcatttctggccggactgtgccggcatagaattaggtgaatacctgaaattgacaccggagatgaacggaatgaaatgtagggtgatttatgatggaggtggaataaaagaaattagttatgaagcctatcagatgcgtccggtacattctttgcagttggtttattcggatgatatagattatacttataaaagtacagacagggaagctttaaaccggctttttgcctgccgtggagaacgggatgatattttaattgtcagacgcggactgctgaccgatacttccatagctaatattgccttgtttgatggtaaggattggttcacacctaaattacctttgttgagagggacttgccgtacagcattgattgacaacggaattataaaagaaaaagatatccggccggaagaactatcctcttattcttttgttaggttatttaacgctatgattaaatggggagcgttggaattttctaccggaaccatttacggataataagaaagaaggtggaattttgaagatttttgtttgtttccttaaataatttgctatatttgcaaaaaaaatataaatataggtagggtatgagattgcggacagttgccaagttgggtatggtgctatcagtggtattgttttgtacggctgtgggcttttacggctttgctaagttaagcctgacggataagagtcgtgagatcaatctcttctcacttgtaccggctgattgcatcggtgtgttggagagtgataatattaattattttctgaatgaatttcctcaattgaactattctgaagaactgggtaatttccagtttcccggtttgtttaattatgtgttgggaggtttgaacgaatataccactaacactgctcatggtctgagcagtaagatgagccgggtggtggtcagtttccattctccgggtactccgcgtgaccaggtggtatatttccgtatgggggctgatgataaggaaacattgggagatatgttgttagagagaactccgggaagtttttcacctaaaaaagagaaatacagaggaaaaactatagcagtctatccattgggcaataatgattttctagctgtctatagcgaggcgggattctatgtggtgagttatcagaagagtttgatagagaaagtgattgatgcgcgtgaggatgaagagaaagcattgagtaatgatcccgtgtttgccaaagcgatgcagaaaaagaaaacgcataacttcctgactttatacggacgtacaccgtctatgcctttcttgcaggataacagtggctgttggagtgagtttgactttcacatgaacagtgatgtggtgtacctcaccggagatacttttatgcctgattcatgcggctgtgtgaaccagatggccgaaaaattgaagaatattccggatataagggaagatagtttgattatttctgctgataaagattccatggcaaattatatggaagaggcctacgaaagaaatagcaggacattgttcaatgaatgtgtagccaatctttcacgtgatgcagcctttatgcttgtggcggacatgaacaagatttcccgcaacccggaacgtttcgagccttatttgccggcatttctgttggagaatgctcctttattccattcgtttattctttcaacccaattgtcggttgtgaacgaccggctttcccatatcatggtactgacatataaggattagcgcaacttatgtcggtggaagtggggagccactttgcttctaaaataaaataacgaaataacagtgagtgcggctccgaatagataggccatcttgaaggtggctatttctgctatatatccgcccaataacatgccggcacctatacctacatcccacgaagtcaagtaggtactggttgccgtaccacgctggttgttgggggccaagttcacaaacagcgtgttataggcagggaacatggttccaaacccaatacctagtaaaagagctatggtgaacagaaaataagtggtccattgcagactccatgttgtcagccatccgcatgaactcaaaccgaagaaacagaagcagaccagatacaggccggcttcaataacttgagtaaccattccccggtctaccaggcgtccggagaaaagacgggaaactgccattcccaacgccatgaaggtgaagaagaaaccggtggatgactggatacctatttgcttggcatacattgcaacgtaattggtggtcatgccataagggatggatagtaataacagactgaaacctgccggtattcctttaagcaaaataaagcggtccaatgatatcggttctcgttttacaggaggtttgtaggtggtctttaccaatgaggcgcatagaaatcctatcaggcaggaacctaatgagcaacagaagataagcgtatagtctgctcctgcatcatgtaggaagagtccggtcatcggtccgatggacatggctatattgtttgccagcccataatatcctaatccttccccacgacgtgaagaaggcatgatatcaatgacaatggtatttccgctgactgtcaccatgccgaatgatactccgtgtataatgcggaataaaataaataaggttagtgttcctgcaatgagatatcctccgaagatggcggtaaaagtgaaataagccaacagataaagtggtttgcgggcaaatgtatctaacagatagccggaaaaggggcgtatgcacagggcggcaatggtgtaacaggaaagtacggcccctatggttgttttgttggcgtcaaaaacttctgccagatagaaaggcaatacaggcatcagtaaccagaatccaaagaataatagaaaattggctgccagtatttctatataatttttggtaatcagcttgtccttcataagcaataatgtgctaatatgtcaatgtatcaatatgctaatgtggcaatatgttaatatgccaattgaccgcgttctattccgcatggcaattggcatatcagcacatggtcacattgacacattattaattggctgcttcgaattctttcaggaagcgggtatcgttttcagagaataatcgtaagtcgtttacacgatatttcaagttggtaatgcgttcaatacccatacctagcgcatagcctgagtaaactttgctgtcaatgccgttggcttccaatacattcggatccaccataccacatcccagaatttccacccagcctgtgcctttacagaacggacaaccttttccgccgcaaatattacaactgatatccatttcggcacttggttcggtgaacgggaaataggacggacgcagacggatttgagtatcttcgccgaacatttctttggcaaacaacagcaatacctgcttcaaatcagtgaatgatacattcttgtcaatgtagagtgcttccacttgatggaagaatgcatgggcacgataactgatcgcttcattgcggtatacacgtcccggacagatgatgcggataggaggttgcgaatgttccatagctcttgcctgtacggaagaggtgtgagtgcgaagtacgatgttctttttcacatcttcctgattggcttcgatgaagaaagtatcttgcatatcacgtgcaggatggtcttcggcaaaattcatggcagtgaatacgtgcaagtcgtcttctatttcgggaccgtcggcaatactgaagcccagccgatggaatatatcaatgatttcattctttacaatgctcagcgggtgacgtgttcccagttcgatgggataagccgtacgggtaagatccatttcggttgcgctgttatcttgggtttcgaaagcttctttcaatgaggcgatacgctcctgagccttgttcttcagctcgttcagtttcatacccacctcttttttctgctcggcaggtacgttgcggaagtctgccatcaactcattaatcgctccttttttgctaagatatttaatgcgcaaggcttccaattcttccgcattggctgcttgcaagccttcaatttcctgaagtaattgttctattttagctaacatagtttcttctttattttttaatgaccgcaaagttagcgaattaaacccatatattttgctgaaaactaaaaaaaacgatatttttgcatcgattttttctaaatatagaaaatgagaaaacttataatcggagtttgtctgcttatgctgataagctcctgtggaggtgggaaaaagaaaatggaccccttcgagacgcttactgaggagattgattcgctgactgcaaccccggacacaacagaagcgatggctgcggtagaggaagaaccaatggttcccgctacggccgacgaaagttttgccgactttttctacaattttgccagtgatgaaaaattacaattgtcacgcatcgtgttccctttgccgtattatacaatggaaaagaaagagcacattgaaaaggagcaatggaaacacgatcctttattcagccggcaggatgcctatacagttctgttcgataaggcagaagacatggaaatggagaaagatacgggtctaaccagtgtcaagatagaatggatttacttgaagaagggaaaaatcaagcggtactattttgagcggctgaaggggctgtggaaactggaagccatagattttgcggatatgccgagagaggataccggtaaggaggacttctttgagttttatgaacgttttgccaatgattctgttttccagttgtctcgtttgcacgaaccgttgaagtttgtgaccgctgatcccgaagacgagtttcagatattggaaacgactttggaggccgggcaatggttcgcattccagcctgtattgcctcgtgagaatctgactaatgtaaactatggccagaacgagaatgtgcattccaatacgaaggtgattgaaatgaaaggttttggcaatggatttaataatacgctctattttgaacggcgccacggtttgtggaaactgatgcagtttgaggatctgagcgattgatttgattgtaaatgaaggaaataaaagactactctctgttgcctcataatacatttggtatggatgtgaaggcatctttgtttgtggaatatgaatcggtgacagagctgcaatccatcttgtcggataaaaaactgatggccggtaactggttgcatattggcggaggaagcaatttgctttttaaaggtgattatgcgggaactgtcctgcattcggctatccgggggtatgaggtggttgctgaaaacgaacaggaaatagaggtaagggcaggagccggtgaggtgtgggatgattttgtggcatataccgtgaaaaacagttggtatggtgctgaaaatctgtcattgattcccggtgaagtgggtgcttctgccgttcagaatatcggtgcgtatggtgttgaggcaaaagatttgattgtaagtgtggaaaccgtcgaggtggaaaccggcaggaaacggatttttaccaaagaggaatgccgttatgcttatcgtgaaagcattttcaagaaagatttgaaaggtaaatatatagtgacttacgtcacctatcgtttaagtaaacagccggtttttaatctggagtatggaaatgtgcgtggcgaattggaaaagcgaggaggtgaggtggcattggagaatgtaaggaaggtgattattgccgtgcgtgaagccaagttgcccgatccccgggtgcagggaaatgccggaagtttctttatgaatccgattattccacgcaggcagtttgaaatagtacagcaacagtatcctgatatgccacattatgaggtggatagcaatagggtgaagattcctgctgcatggatgatagaccgttgcggctggaaaggcaaacaaataggacgcgcgggtgttcattctaaacaggcattggtcttggtgaactgtggaggcgctacgggagatgaagtgattgctcttgccagacggatacaggagtctgtgcttcaaaagttcggggtggctatctctcccgaagtgaattttatataaggtatgatatgaagattacaatactaggcagcggaacgtctacgggagtacccgaaatagggtgcaaatgtccggtatgcaccagcagcgatccccgggacaaccgtttgcgttgttcgggactggtagaaacggaagggctccggattctgatagattgcggtcccgatttccgtgaacagatgatacggttgaacgatttcaagccgttggacggtgttttgattactcatgaacactatgaccatgtaggaggcttggatgatttgcgtcctttctgtcgttttcgcgatgtgccggtttatgccgaacaatatacggcagagcgtttacgccagcgtattccttattgttttgccgaacatctttatccgggagttccccgtattacattagaggaaattgttcccgattctccttttattatcggcaatcccgaaggaaacaaagtagaggtgacacctcttcgggtaatgcacggcaaactgcccattttgggataccgtatcggccggatggcatggattaccgatatgttgacgatgcctggggctgaatatgatttgctgcaaggactggatgtgttggtaatgaatgcattgcgtcctcagcctcaccatacccaccagaatttgaaggaggctttggacaatgcacaaagaataggagccggggaaacctattttattcacatgagtcatcatataggattacatgctgatgctgaacggttattgccgccgcatgtgcattttgcatacgatggaatgaaaatttgtttataaagccggcttcaacgaataccggcacaatccgttcaacccgcattccgaacatttcggtgtccgtgccacacaaacatatcttccgtgtaaaataagccaatgatgtgcggtgggcacaatctccttcggaatatatttcatcagatatttctcggtagccagcggtgtggtgcaggtttgaggaaccagcccgatgcggtggctcacgcggaacacatgtgtatctaccgccatggccgctttattgaatactacactttggatgacattggctgtcttgcgtcccactcccggcagtttgaccagttcttccaatgttcccggtacttcgctatgaaaatctttcaccagcatttgcgccatgcccaccaggtgttttgccttgttgttgggataacttacactccgtatgtattcataaatcacttccggcgtcgaagcggccaatgcctcaggagtcgggaaatcccggtaaagaggaggggtgatcatatttacccgtttgtccgtgcattgtgcactcaggataacagctatcaataactcgaatgggttattgtaatgaagttcggtttcggcaacaggcatcgcttcttgaaaataagcgatcaccttgttataaagttcttgttttttcatcttaccttcttttttcggttacaaatataattgataaatcaatagggtagaattattcgggcaattcatttgtttagttgagtaaacttcttatatttgcataaatatattagatttatgcagcttaacgtaaggaatgaaacttctacattgaaagctgtggtgcttggacaacccggttccatagggaaggtccccacgctggaagaaacttatgacgccaagtcatacgagtccgtattgcataacatatacccccatgaagaagatattttcaaagagatgagatgctttgaaagcgtattgttgaaatatggggtacaggtctatcgcccgtggacactggagaattgtaatcaggtgtttgcccgtgatgtggggtttgtgattgacgacaagattattgtttccaacatcatccccaaccgggaggatgagaaggaagcctacgaagtggtctataatcagatagcttataacaagattttcaaccttcccgaaaaggcgcacgtagagggaggtgatgtggtgctttacaataatatagtgtttgtaggcctttatacccagcccgattacccgcagatgaagacggcacgtaccaaccgatatgctttttcctttctgaaagaaatctgtccggggaagatattcatccccttggagctgaaaaaacataatacagatccacgtgcggggattctgcatctggattgtacctttatgccggtagggaaagggcatgcgattatttataaggacggatttatgtatcctcaggattatcatactctgctcgatttgttcggcagggagaatgtatttgaaataacgcgggaagagatgtactatatgaatacgaatgtcttttccatctctcctgaggtggtggtttctgaaaagaactttatccgcctgaatacctttatggaagaggtatggggaatgacggtagagcgtgtaccttattatgaaatatctaagatgggcggactgttgcgctgctccaccttaccattaatccgagaaaatgactaaacaaacaacaaaccacattttgatggtggaacccgtggccttcgggttcaatgaagaaacagcggccaacaattatttccagcagcggacagttgcggcaggtgaaacagtacaagcttgtgccttgaaggaatttcggggcatggtggataagttgcgtgcaaacggcatagaggtaatagcggtgcaggataccccgatacctcatactccggattccatatttccgaacaactgggtgtcctttcacgacgacggaacggtggtgctgtatcctatgtttgcggaaaaccgcagggcggaaagacgggcggatatcttgcagcggatagagtcggaggggttcagcatccgtcggaaggtagattatacaggttttgaggaagaaaaccggttcctggaggggaccgggggaatcattctggaccgggtgaaccgttatgcatacgcggctttgtcgcaacgggtggacgaagctttattgggccggttctgcaaggagcagaattttattccggtgtcctttcatgcttatcagactgtaaacggacaacgtctgcccatttatcataccaatgtcatgatgtgtgtggcgacagattatgcggtcgtttgtctggacagcatcgacgacgtggaagagcgtgagcaggtttgtcacgtcttgcggcagacagggaaagaaatcattgccatctccgaggaacagatgcatcactttgccggaaatatgcttcaggtggagaacgggaaaggcgcattgtttctagtgatgtctcaaagtgcttacgattcgttggatggaggccagttacaacggctgtctaagtataacgcgttgcttcccatgcccatccctaccattgaaacgctgggaggaggaagtgcccgttgcatgatggcggaaatattcttgaagaaagaaaaacattaaataataaaaagcttatggatgcaaaattatcggcagctcaattgatggagcttgagaacaaacatggagcacacaattatcatcctgttcctgtggtattggataaaggagaaggtgtgtttgtatgggatgtggaaggaaagaaatattatgatttcctttccgcttattcggcagtgaaccaaggacattgtcatccgcgtattatcgatacgttggtaaaacaggcgcgaaagctgactttgacttcacgcgctttttataacagccagttgggacggtatgaagaatttgtcacccgttatttcggatatgacaaggtcttaccgatgaatacgggagccgaggcggtagaaaccgcattgaagctttgccgcaaatgggcgtatgaagtaaaaaagcttcccaaggatacggcggaaatcgttgtatgccggaataattttcatgggcgtactaccactatcgtttctttctccattgatccggacgcttacaataactacggaccttttacccccggttttgtcgtgattccctacaatgatgccgaagcattggcgaaagtgctggacgaacatcctcatgtggccggattcctggttgagcccattcagggagaggcaggtgcttatgtacccgatgagggatatttgaaaaaatgttacgacttgtgccgtgcccacaatgtactttttatagccgatgaagtgcagaccggcattgcccgtacaggcaaattgctggcttgtgactatgagaatgttcatccggatatcctgattttgggaaaggctttatcgggtggggcctgtcctgtttctgcggtattatcatgcaatgaagtgatggatgttatccgtccggggcaacatggctccacttttggcggaaatcctattgctgcggcagtggctgttacggcgcttgaggtagtacgggacgaacagttggcggacagggcatacaggctgggactgatattccgggaagagatgagaaaactgtgcgaaacatctcgtgtggcttcttttgtccggggcaagggattgctgaatgcgttgataatcaataatgatgaaacgaaggatttggcgtgggagatttgcttgaaattggccgaaaacggtttgctggccaaaccgacacatacgaatattattcgttttgctccgccattggtgattacagaggaacaattaaaggagtgtatcgaaattataaagaagacgattgctttgtttgaataaaggattttttatcctgtcttttaggggtggattcaatctgcccctaaaatcgtttttactgatacccacctgtttgtgacgcttcatctttcattgttccatactgtttggctatagaaaaggtaattatttgatgaggctgtttcttcttgataagaatatttaatgcagttatatccggttaactcggaaataatttctatctttgcaccccgaattaaaaaatagacgtatgatgccgtgaatagcggtcgtgtattctagaacaccacgtaaaaaacaggagaaatgaagaataataatactgtatctgtatcgttcatgttgcttggcatactgttttgtgtatgtcttgtcgcagcaaatttattggaaaccaaagttgtccagatctggaaaattacggcaactgccggattggttgtatttcctatctcttacattatcaatgattgtatagccgaagtatggggcttccgcaaggcacgtcttatcatttggatgggctttgccatgaatttcatggtggtagctttggcgcagcttgccattctgatgcccgcagctccgttttgggaaggagaggagggcttcaacttcgttttcggcatggcgccccgcatcgctgtagccagtctgaccgctttcttggtcggttcttttctcaatgcctatgtcatgagtaaaatgaagctggcttcgggaggaaagaacttttcacttcgtgccatcacttctactttggtgggtgagagcgccgattccatgattttctttcctgttgcctttggaggtttgatgcctgctggtgaactgataaagatgatggttattcaggcagtgctcaagacactctatgaaattattatcctgcccgttaccatccgtgtggtaaattacatcaagaaggtggatggcagtgatgtctttgatgagcatatctcatacaatgtattgaaaatcaaagaactttaataaggtgctgatgtgtcagtgtgccggttagccaattaccatgcggtatatggcgcagcatatccacatagcgcggcaattggcacattggcgtattagtaaattgaaaaattgtcaacaatgaataaaagtgacgcattggttgtgttcagcggagggcaggactcaaccacttgcctgttttgggcaaaaaaacatttccgcaaagtgtatgctttaagctttatctatggacaaaagcatgtgaaggaagtggagctggcccgtgctattgccggaaaggcaggggtggagtttaaagcgatggatgtttcctttataggcaacctgggtaaaaattcgctgacagatactacgataacgatggatgaggtgaagcctgccgatagtttccctaatacgtttgtgccggggcggaatttgttctttctgagcattgcggctgtctatgcacgcgaattgggaatcaatcatatcgtgaccggtgtgtcgcagacagacttcagcggttatcccgattgccgggatgcttttatcaagtcgctgaatgtgacattgaaccttgccatggacgagcagttcgtgcttcatactccgctgatgtggattgataaagcggaaacatgggcgttggcggacgaattgggcgtgctcgatttgatccggcatgaaacgctgacttgctataatggcgtacagggggatggctgcggtcattgcccggcctgtaagctccgtcgtgaaggattggaaaagtatctggagataaaggcggaaagagagaaatgataggataaacgaaggtgttttctctttgtatgaaaggtgttcctttcttgccgggtatatcgtttcactttagtgagcaagttttatcactgaagtgaagaagtttcatcactcaagtggtacagtttcatcactttagtgaaacgatgtacttggcagggagagaatttctattccaaggtatgaaagagaaaacatgaatatgaaaaaaacagattttaatggaaagaaaagatgaattgacccttctcgggtcgaagaccgagtacaggcaagattatgctcccgaagtgttggagtcctttgtgaacaaacatcccggaaacgactattgggtacgttttaactgtcccgaatttaccagtttgtgtcctattacaggacagcccgattttgcggaaatccgtatctcctacctgcctgatgtgaaaatggtggagagcaagagcttgaagctgtatttgtttagtttccgtaatcatggcgattttcatgaagattgcgtgaatatcatcatgaaagatttgattaagctgatggatcctaaatatattgaggtgacgggcatttttactccgcgcggtggtatttccatttatccgtattgtaattacggccgtccgggtactaagtatgaggaattggcggagtatcggatgcgtaatcacgatttatagatgtatctcttggaatgattagatagattgtgggctcaaatatttgctggttttgaaaatttgttctatttttgcactccgaaaaaaggagaggtgctcgagtggttgaagaggcacgcctggaaagcgtgtataccccaaaagggtatccggggttcgaatccccgtctctccgcgataaaggctgagaatcagtaaatagcaaaacaaatgctcggttttatactcaataatgtaaagctgggtctttttgtgttatttgagaaacaaaatagtgtttggatttgtagcctcattttgaaaaagataatattctatattagaatgaaaagatatattaaaggttgcctttgtatatatgcggatgcattacataggcaacctttagttatttaaggggtaattactagggaaatgtttctgcaatttgtttggcaacgcgttttatagcacttctgatgtctgcggatacgctgaatcctaaggtggtgtatgcaccgcgacatgaagctatcgggcggccggtgaggtaatctatgaaatttacagttacaatggatttttcttctaaaacatctaccccatattttaccataagcagttttgactgttgtgtagcagtcaactcgtttatacgcatatcattgattaacttaagacgggagccttctacggcatcaaacaattgtatctcgtattccatcaattgagccggaatatgataagtgtcattgttgataattgaagcatattcatattttgacaaatcaacattttgcgatacgacacttttagaggttgtacaagatgatgctgttattccgactaaaaacaggaatgtgataattattttattcatagaattgttatttaggttctatatgcaaataatatctttcttgtactaactcgtcagtgccgtcagaaagttgatgcaacatcaacatatgagtggttggattttcccaatacaattcagctttcacacctttctcaggcaggcatttgaataagttttctttctctttggcatcttgtcccttgccaaaattgttttccatcagtgtcttgatggctttttctgttgttggcggaaaatctgcatctgatagcgatttatgatttaccgggataatttgggaataaggagcgtcgttctttgcaacaatgtcgtatacctgatattcaaaatctctatccaataggcaataggctgttagattctgaggattctgtaagacaatcgtaccccattcaagtcctaagaagtcgcgattataaagcgttgtattgagcgaagtctcatatttcacttttccatgacggtagcctttaagacggctttttacagtaccactcttgaaaaagtgtgaactccattgtttagaaagaatcttttcttctccttctgctgtaacattatgttcatagattttgaacgtgtgaggaaaatgatctgcactccacacaatagaatcgtaatagtttgtaaacttaggaaaaactgtaggcatataatgaccgtttatgtccgttattcgaaatgttatcaaatcgaggggtgatggcaacagactttcaatatgcatcaagggagtaaattctgccataatcatcttgaacttagcttcttccggcaaagcctccggttctgggtctggttgtccattatctttaaagattctggataaacagatggttgtataagctgttctttccccgtcatttgccgaaatccgaatctcttcgtatgcatccggagaatccgaaacagacggagggaaatggattttcacttgattggctaattttgaatgtatcattctttgtttcaaatcttcgtctatgctcttcgaaatagattttccgttgcatctgatagttttcccctgcataaacttcatgaatgaggggaagcagtttcatgctgaaatattcgggtagtttggctgttgttgcatccgtttctgtttccggttggctgtccgtatagctctgctggtcggtttcttccggctgtttttcattggtatctttcatcttcatgttgaagcatctttcagctgttggggagttggcatggctttctgtacctcaatttccttggaaacattctgaatttcagtatcatatatcagcaaattcgtattggtttctgatgcgctttgctttagcttcttgttggatccgttctttacccgttgcttgtctgcatctcatttggctctgtcaatccggtagcccgttgtaaactggggcgtggctggcaaagatgacacacatacggatataggtacgttctctacgattggcacacgttctttttccgattctccaatgccaaaatgatgttacgcttgatattcataattggctgcgtttgaaattctacacctaaatatacacccaataattgagatagtaaaagacatttagaaagatttagatttactctcaagttcctttcttcgcgatgcggaatgacaacttcctttcgaattgatgataatattaaaaaagaacatctacccggttgccttgtataaataaaaagactgttttacgtaattctatgtccagtgcacgtaataaaaatacaattgtatgtttctaactttgcactatcaaaataaacatcataaaacaagtatttttacttaataaaataatcggcgacaatatgaaaaaaacatgcttttttttctttctgctgttcagcctgcaggctttctcacagaaggttgtgctaaaaaacaaccttgtctatgacgccctgctgacacccaatctttctgtggagctctccctagggaagaaatggactttggatacccaagtgggtatgaatttcttcttttatgaaagtgatgctaccgcaggcggttacaaaacaaggaagtggagccattggcttgtacagccggagataagatattggacctgtgaaacattcaacggctggtttcttggtcttcatgcccacggaggacagatgaatgtaggaggcataaatattccttttatcattcaaaaccactccaaagaaatgaaagattaccgttatgaagggtatttttacggtgggggtatcagtacgggctaccattggatactgtccagcagattcagtgtagaggcatccttaggactgggctatgcgcgtgttaaatatgacaggttcagatgtacttcttgtgggaagaaagatagtaaggggaaagctgattatctgggacctacaaagcttgccgtttcgattatctatataattaaataaatgatgctttgcatatataaacattaaaaacagaatcaatgaaaccaatacaatattatataggaatactctctgtgctggggtatgtatactgtttgccggtggtaggacaggtggaggataaggttgtcagaaaggggaatccccgtttggaatatacagatgtgaaaaccggacgtagctcggaagggaaaatgtttaccgtttctttcaatatagtagaatccatcaatcggttgaggacacaggaaattgtttatatctatccttctctggtatcttctgacggcaatatcaggactgctttctcgcctttgtgtatttccggaaagaaaagatacaaggttgttgcccgtaaggaaagactgggtggtaacccgggtacattacttcctgtgaaggatattcgcagttctagagctttgagggagtctggaatctccgtcagggaaacattgccttttgaacgttggatggcttccggccatctttttcttcgtgaagaggtgtatggatgttccgagtgcggtaaaggtgtgagccagttgaatataccggtaaccgggatagacctttttggcccggaagactataaatacattttttatactccggaaaaggtggagataaaatgttatgaagaagaatttgactgtaaggtcactttcaaatccgcacagcatgaacttcttcttggatttggtaaaaatcaggaagaattagcccgtctggatgattttgtatccaaagggcttcggatcaaaggggctaggcttcgtgaggtacatatcatgggatacgcttctccggaaggtgagtttagttataataaacatttggcggaacgtcgtactcatacgctttcttattatgtactgagtaagtacccgcagctcgagaaagcctccatatacgaaatagaaggggtgggtgaagactggaaaggcttggaaaatattataaatgtatcttctttggcatataaggatgaaattttatccgctattaataggcatcatacggatgtggcccgtgaagtggctatacgctctttagatgggggaaaggtttatgcggagttgctttccacagtttatcccactttgcgccgtaccgtttttcgcatgggatttgatgttcgtccctatacggatgacgaattggaggaaatgtttattaccgttcccggatgcctgagccagtatgagatgtacaggctggcgcaacagtatgccgaacagggaaaaaatccggtaaacatatacaagaaggcttatgaacagtttgcacttgatccgctggcggcactcaactatgccaatgcgcttttaaagtatgaaaaggatgcggataaggctctgatgatattggacacagtaaagagtgacagccgttctgtttatcctatggcaattgcccatagtatgaaaggagactggcggaaggcggaggaattactgaaaaaagacatggagccccgggaatgaaaactcctggactttccatgacaggattaacggataaatagcaagcatttaatgtattaataattaaattatttatttactaaacagtttaagttatgaaagtaaacaatttatttttagtgggagttgcagccttaagtctgggcatgacagcttgtaataatgaggatgtccctcaggtaaacaatccgggcgagggaacaacatttgcaggaatgtatatttccgctatgaaggatgtttcaaccagagcggtgaatgacaatcaggaagattatggaggaagaacggaagagagtaagcttacggaattacagcttctctcaaatgtcctgcctcaaacatggatgttaggaacggtagctgatgaaacaggcaaattttgggaaacgcaaacagccggtacattcaaggttgctccatggaagacgaatcccggtcctcaatccatggcactgttgtttaacaagggtaccctttccgccgatattgcaacagctgcggatcagacatatggtagtacagctaccgcagtaaaagatattgctgctcttgccacagacaacaagtttgtcatgacttcgagagccgagcagaaaactattgttcccagcattaccgaggatgctgccaaaacgggtacaagtgaggctcaaaatgtattctcctttgatgtggagcgtatcgtggcacaaggactggttgcgaaggatgccgcattgaaagaaacaaccgcggatggaaaaggaaaggttgatcttaccgacatcacgtatgctgccatcaacggtgccgcaaagacatatcttttccgtaaccatgcgggaaagcgtacaattggagataccgacggtctttacgaggcctttgcatcagccattgatggatataccgattttgaggcggccaaagaaccggaaggttcagctaaggattatttgatccgtctagggaatctcttgccggaagagacttcaacagcgaaagatcttggcatgtatgcagctaaaaacgttgcagaaaatgttaatatcgctaaaaatgtagcaggtatttatttttttgaaaattctgtaaaaaaggaagcacttacagctgaaaataaaaattacggttactatcgtctaccttatgccaaggtttatgcaacttatatccctaatgaagtatgggagcttgataatgatggaaaaacattggttaaaatgaataactatacaaaaggaacaacattctatcggggagaaggtgatggacttatctatgccagcaaggaagccgcgcagaaaagtcagttgagcccaaatcaaaaagcttatacctatacgaacggaaaatgtgcataccgtgcgttgtggaaccgtcagactgttacagctgatggaaaatcgattgtgaacgctgacacacgccgtaacaacacctatctgttgacaatcaaggctttccagggcctaggtatgccatgggatccttccgatcccaaagacccatatctgccgaaaccgacagatcctactgaaccgacaaatcctgaaaatccggatatcgagaaagaagaaacctatatgcgtgtcgaggctaaagtgctccaatggaacctcgtttcacgtgatgtcgttctggagtaattttagtattagattgctgataaattcagcctataatttcttacatagctgtagagagggaagaggaattttttcctcttctttctccaatcaacaaacagtttggtttcaaactgttaaataaccccaacataaactatatcaaatgagaatcagaagtgtacattacatcgcatttatcatgttgctggtttactgtcttataggatgtaattctgcggtatttgatgacttgggtagttgtccgcaaggtgtttatttccagttctatagacagaccccttgcgaacaatttcctggctatccgtcagatatcagagaagtccgggtatttgtctttgatgatgaagatctgctggtgggcgaattttctgacaagaaggcagtcctttcggcagattattctttgtccgccacattgcggtatacggggaaactcacgtttgttgcatggggtggcagtgacctggaggcctatgatttttcagattttcgggaaggcgttactaccagacaggaaatgcaagtgtcactgcggttgaaaaacggacggatttcctcagcccccgggcctttgtatgtcggtctcgcctccatatcactggagaaccggaagaatatgggaagcgtgtatgaacgggtggctttcaatatgcaggaattgacataccgggtacacttcacaatcagctccataggttcccctttccccatagacgaggaattcgtcatcaggatagaagatgacaacggtgtgtatgatttcaatggccggatcgccctttgcgaacgttttgaatacgcgaccgaagccgtacgtgacgctgaaggggcattgaaagcggatttcacgctgatgaaactggaagagggaagaaatgcattcgtatctctgattgacaagacaaccggggagattctttataccgctaatctggttgatgacatcctcatgttccggggagatgcgggcgaaccgccgtatagtctggaatgtgaccatgattttcccataaccctgaaactcaagtacgaaaaggaaacatggatgctgatacaagcgactgttctggattggaatgtcgtttcccgccccatagaattggaaaactgatatcatgtcaggctagtttaaaataaatgattcgtgtaatattagaaaggaattgagattattaacaaaaaacgatagacaatgaaatacggaactgtgataaggttgttgacggtggcttgcttggcgattgtacagttgaccggatgctcgtctgatgtggaagagatggaagaggccgctccgggtattcctatccggatcgtggcggaaatgaatagagggggaggtacttcccggacggtaggagttcctgcacgtttatccggagaatggaaagagaactatatcggtgcagaggaatatgagaaaactgtcaaacatgttctcctcttcgcttacaggaataccgggaactctccggaaaaagtccttttctattatccccagggaacggtcaatccgctggcaggtataaccggcattgaccatttcgagatgaaagagataagtggaataaatgtgggggactccaatatagccttggatctggaactgatgggtggcaattataattttgtcttactggtcaattgtgaatccggactgaaaaagatccgggaggaacatatgattcctgatccgaaacagctgatggagaaaaccgaaattttcacatctgacgatctgaaaggagaaaaccgaaagtatcttcccatggtgggccaatgcaacttccgcgttccggacaacatggacggcgataataggataactctttctcccagcatacttttggaacgtacgcatgcccgtgttgagtttatctttacaacggttgatgacgggggaaactatctgtctcctttgttaccgctttccaaagtgacgaaactctctctgaataatgaggtcagcggttattctgtcctgccttctgccggggaatatacggcaactggtgggggtaatccggatatcaggggagtagactacgtgggagatcccctgttattgccggaaagagccagtttccatgaaggtgccaacgagggggccggagaatccgcttttgtgaccaaatgcaaagaaagactgcttccatatacgggtatgacacctaactacatctatgtagctccgggagtctacggggaagggaaagagggggcgatggccttggtcttatccgtcgattatcggatgggaacccccgataaggtatataggatcgagctttataatccggatcttgatcaaagtgataaagattattacaatattcgtcgtaatactatttaccgtgtcttcgccacactgaaaggacccggaaatatggaatatgacatagttgtggacgaatgggaggatacggaggtggctatcccttggtaactaaggtatggtcagtcatgccatcacgaagaaaaacagtttaaagaatagatacatatgagaatcaaacattacactttgatagtcgcttttctggcgatatctatgggaatccctcttgtgcaagggtgcagtgatccctttgatgagtatggaaacggtgggacagaaatgcctgtcagggacggctggacgtctgtcagcatgtctgtcgaaggacttggtcttcgaaatcccctgacacgctcccttacaccggagggggagaattccacggcagcggagaggattagggtatttgtgtttgacaaagacaacaagttttcatatgaggccaaagtgctctcctatattccttccggtgatccggctgacaagaaaggtaagggtaccatgaccttgttggcgaaaaatactccttcaggcgataccagtacattcgtaatgctggccaatgtcacccggtctgctaatacagacgcagacggactggctggaaagacacgggaggaagtcatgcaacttttcactttctccatgccggacaagggggtatggaaagacggggagttgccgatgtggggtgtttcggacccggtcagggtggaacacagtgccggtgccgttcccaaacttggaactgtctatctggtccgtgccgtagcacgtgtggacgtggggcttaacttgagcaacacgtcggaaggggcttctacattcgacgagaaagccggggggattgaaggaataacgctgactaaagtatttttttataataccaatacgacgggacgggtctctccgttcgagaacgggatttactgggatgaggccaatagaaaggcgaaacagccttctattcctgatccggctccggctgtgacaggaaagattgatagaacatcttccatagtggatgagaaaatcttgttacgtgaggtatatgttccggaggcggtcaatgtgccgacggctgccacgcaaggaggcaacggagagactcttccggagaataatacggaaaattatttgaaacgtccttatatcgttgtcggactgaccggtgcagataaaagccgtcctgacaaggaaactttcttccggatagactacctgaaacgtactggagccgaggctgatgcgacatacgagtaccttcccttgctgcgtaaccaccgttatctggtgaatatcaaggctgtaggtggtccgggattcgatacggaagaggatgctaggaaaggaccggccgccaacatcatgtacaatgttgtagtatggaacgagtccactatgtctgatgtattgtatgacgggcaatatatgctgggagtcagtgccgatcatttcactttttatagggagggaggtagcctgacggcaaaagtgcagacttcctggccggaaggatttacggtagagggactgcctgcatggatcagttattctataataccttcggatccggataagaccgcaccgacggatgagaaaaccgtgacctttacggtcacagagcatgtggatgcatcccgaatgtggccggaaaagccggaagatgctcagaatgcgttgaaagccgcttatgtgaaggcggggcgtatgaaatggttccttggttttgagcagtctaaggatattaatgtcactttacagatttttgcggacgaggcctgcagtcggccgctggagtttattgaggtcaatcagtatggcgagagctatgggcaggcgggcaaagtggtaacgaaagacgggcggacgcttacggcggaagaggtaggtgccagggttactttctatgtaaagacagaaccgcatgatttggaacccgtattccatgctgaagccgccaatccgtttaagatagagaaagcgggtcaacttgccgggggaatatggaagtatacggtgacagctcccgacattacaggaaatacggagtatttcgataatttcaataccacttatactttcaccgtcacacatgtggaaaccggtagaagtgcgtcggggaaactcagcctcttgcagaaagaatataatgctatccccttttttgacaaattcttgcatcagtcattgctggtatccaataacagtatttatctgatggatggcaaacagaagcaatattatgtcaaagccaacagcgaatacaaaattgagttggtttcggctttgtctgacaacaatgctggtaatgtgatagaggactttacgcttttctatgagaaggatccttccctttcgggaaaacctgtgcctttcatagctgttgacgatatggcgtctccccatctttactccggtaaagcgaaattcaagatttattcccctgatggtctttttccggaaagagaatttgagttggagctggtttccggaattgtgcagcctgaagcgaatacatatatgcttaaagcgggagcaaagcaagggatctttattcctgtttcccgggtaaatactgcctatgagtattataatatgcttttggaacatgacgctgttttgagtggcaaacaggggcttcctggaagtaaatcggattttatgctgaacaagctggatgaagatgatgactggaaagtcaatattgtgtggacggacattcaaaagtctgacgagcagaatgacatagagagagcaggactcagcgagttgtccgaacagggaggtgctggtccgggatcatatatttatgtcaagccagggcagactccgggaaatgtgttgatagaaattaaatctggaaagatcaaggggaatccgacactctggtcctggcatatctggattgttgacaactatccgacagtcttggatgttgcgagtcagggaggtgatggtccgaaaacggttcatttgatgtcgcatctgttgggagcttacgaaagggtccaatcacagtatagtgcagatgcgtatagggagtttggtatgcaatatcaatggggcagaaaagatccgttcccggcacatgatgttcgtgtcaatacaaacttttatgacggcagcggcaagctatttgatttcctttgggaacagagaggaaatgatgtggattatggaagaacagatgctcagcaagcgagaggggctgctcttacgatgaaacagagtatcgaacatccaaatgccatcgtctctcatcaaagtttctggctgtatgagtgttttccacatgggttggttaacaattttaaagaccgttgggtattcctgtatccatggaataaaccttctgcggggaatccggaggatgtaggcgggaaaaccgtatttgacccttctccttacggattccggattatgtcgcagaaagaggctgtaactttgaggtttgcatattattatgcaagtcgttccggccttaacacaccgctgcctggaagtgtttatgacggcagttttacagatggcaaatctggaggtaatgaagtcattttcgccgtggcacaagccagaagcgatactcatgcagggcattatctgcttaattccactggaggtcctgccggttgggcgcctacttccaatacaagcgctgtttacaggcgttgcatgacctattccgtacgtccggtcattgatccggatgtgcaggaagattacaaaaagtatttgcctgaataagtcatactccgtgtgagcttttgcttgcacggagtaaaaaatcttgttgtatttttctgtagcgtatcatattctggtgtctttttatagtcatatattcacgaaataaatattgtgagaactttgtttcatatcacttttacacgagcatttggtaactcagagatatatcttatgaatgctgttttaggagtcggtatattatcggatggtagtcagtcataaaaatgcatgctcttataacctccaaaactctttatgttccaatgacctatcaaagaccgattgattgaccagtatatgttttgtgtatttaatttgtctgttttagttgagaaattgtctgttttcacaaaaacagctatgtcttgatttttgttgtaataaaaaataagaaacatgaaattactatatctgaatgaacatttatcctgtctgaattaccagatgaattcggatgtaggatttacttgtcagcaactggagaaggatgaggtataccggattgataatagcaagtcgtcgtgtactctttttataattgaaggtgatgtgatttttgatctgggtaaatataaaggtttacgaattttacagaaccagatggtgttcattccacaaaacataggaactcggatgaagtctataaccggttcgaaatgtatgcttttattttgggacaggaacatgagtgtatgtgacaaattgtttttgggctcgttgtctgtcaggggggaggaccgaacggctgataattttattcttcccgtcaggaagcctcttgctgaagtgctggattctgtcggaatgtatttggaggcaaggttactttgtaaacatatgcatttgttgaagcagcaggaactgcttttggtgttgaagggcttttatacaaagaaagaactgacagcgttcttttccgcatcgaccggcatcagacaacgttttgagaaatttgtcatggaaaactataagaaagtgaactctgtcaaggaattcgctgatttatactatgtttccgaacgctccttcagccggaagttccactcctgtttcggggaaagtccttataaatggatgcagaaaaaaagggcggaacaaatgttggaaatgatttgtgatccggaactatcctttcaggaaatatccggcaggttaggtttcagttcaccttcccattttacggcatattgccgcagaatgtacgggatgtcccccactcagttgagagaaaaaaataagaaataaacagatttttataattgcattttaacggagaaactatgaaatatttaaataccggtctggtctgtgagcagtcagggctttcctgtgtggagttgccgaagatctgtataccagtctacagagaggttatcaaggaaatggcagaagtgataaaggactctcagatgcgggatgttttttactctctttctaccgggatagatatactggcagtttccaagaaaacaggtgttacccctaggaatctggcatatatgtataaaaaagcgagcaggcaggttcgtttggaatggaaatcttattctgaatggaaacaagagttggaccgtgtatatatcagatgccggaattatgcggcactcctgacacattcccaagagtgtggcggacagaaattcaagaatgtagtgatagtcgtaagggaacaggatattccgtcggaatgtgtagacttgttagttacacctttaggaaatttggatataaatttcagggtgttacgtgcgcttagaaaatacaatatctatcagcttgaggatcttttacgctttataaaatataacggatttgatgcgctgtgccgaatacccggtatgggaatgaaatctgttgagcagttgtatcatactttaaaagagaggaatattttggaaaataaggaaacttgtatcctgttccgctacctttttgtgtaaaatacataaagaatgcaggaactgcattcagacatttgcaatgactatggatatgattgatgtcttgtctttatttttgaaacgaatagatatactgataaaatgggataattcccctatgtttaattaaaaactggaattgatgaaaaaaaacatcttgattttatgtatgcttggagcatctgccctgactgcaaatggacagatcttattgaaagggacaaagtttacggacaactggtctttcggaatcaatggtggagtgaccactccgatgacacacagcgctttttggaagaactcccgccctgctgtgggcattgaattatcaaaacggataacaccggttctgagtctggggacttcagtcatggggtatatcaatacaagcagtagtaaaacggcttttgatgcttcgaatgttgaacttttaagcaagttcaatatgatgaatcttttcgctggttatcctggaaccccccggacatttgaaatggaagctgtagttggagtaggctggcttcatggctacgtcaatggtacgggggatgataattcctggggtacacggttgggagtgaacttcaactttaatatagggaaggaaaaagcgtgggcaatcagtctgaaaccatcattggtatatgatatggaaggtgactttaatcggcacaagagtcgtttcaatgccaataatgcacgtgttgaactgctcgcagggattgtttattatataaagggaagttccggcaggcaccatgcaactctcgtaaaggaatataatcagacagaggtggacaacctgaatacaagtgtaaacagactgcgcgaccaacttttggacagccggaaacaaacagaggaagcaattggccgtgcgggcatgctccagaagcagctggctgaatgtcagagcaagaaaccggtcattgaaactgttattgaaaaagccaagacactagagtctattgtaactttccgccagggtagttccaaggttgacgtttcacaactccccaatgtggaacggattgcctcctatatgaacaggcatcctgaatccaaggttgtgatcaaaggatactcttcaccggaaggaagtattgaggtgaacgaaagaatagcttgtgcccgtgcggagtcggttaaatccattcttatgaagaaataccggatagccgcctcacgcattactgcggaaggacaaggcataggggatatgttctctgaacctgactggaacagggtcagtatctgtaccttgcaggaaaataaatagtatccggtactatgagttctcgtaatccacatagtatatctgcaaggtgcatgagcattagagattgtatataaatcatggattgcaatgcagattatagttggtctgaaatgtaaggaggtgtctgaaaaaggatgccttctttctttgttgtgccatctgtttattatctattttttgtttcttaatcaacgggatagccatgaaaatcggacaatatttgtgatgtaaattattaagggacaaccgattctatcatattttaaagcgttttcgcagccgtgactttaatgacactcctttaggataagagacaaaatctgataggaaacctcgtaattgcttgtatcggggttgaatgtcggcagctcaaaacttccatctttgagacgcttgtagtaaagaagaaagccgtcaccgttcccacgcagtatttttacaccctatcggttcttgccaaagaacaaaaagacatctcctgatatgggagacaaatctttcatctctgagcgtatgattttgaataaaccgtcaatgccaaggttcatacgaacaaagccctggtacagatagtagcgattggctgatgttagagaatacatggatcaatatccacattgaccaacacgctgatctttccccgcctgaaatcctctaccagtcttccacgttccaaagcgggagtcttgctgtcaatagcaacagactccacaccatgtaagctgtaataggctgcaatctgtcgggcgtgtgcaatacttacggcatagacaattcctttcttcccggcagcatatcttcggacactctcgtacaattggcggataccggtctcccggttcagcaccgcattcatttccttcacctgataatccccgtccgcaccccgcttcttcaacgagtcaaccagccgctgttccctgctgttcgcacggatggacacatagtcaaaggacgacaaccagcccctcccgataaattccgcaatactccatgaggtaatcagggtatcaaacaaatccgtgaatcccttgcggttcagccggcagggggtagcggtcatacccaatttcctcgcctccggataacttttccaaagctcccgataagtttctgccagggcatgatgcgcctcgtcaatgacgatcaaatccggctgtccgtccataatcttccggtttcgtgacaaccactggatagacatcaccctcacacttccgtcctccctccccattccataacgggaaaccgtctcctctatctgctccaccagttcccgacgatgcgccacaatccatacccggctaccggaaccacacaagaactccctcactatggcagccagcaggtgtgtctttcccgtgcctgtaggcatctgtaccatcacactccggtgaagctcccactcttcaaagagcctgagcttcatctcctgctggtagtcacgaagacaatcgttcttgcaatacattatacggatgccagtcgctaccgacaacaaaaacaaggaaggccgcatacgttatcgcatacagcctatagtaaatattctatctttataaatttattttatcggcggttatgaactgttcctccaccgaattcagacaggacctattattgtctatccctctataatccaatcactcaaagtgtgactttccgagtcaaagtttatccccaccttcactacgggaagtccgcaaaacggaaaagaataaaggtaacgaacggtaaccgtcatattataagtatccaacccctatggcaatagtccttatctcctgtattcactggggtttgggatgtatcgtaagattgaattgtaaatatttgattttagccactgaaaagtgcctaaaaaacatttgagctaataatttaagcgatttctcaacgattggcccatgccaatccgatattatggagaagggtaagattaacaaaatgaaacatactattccaccaacgataataaacttttcatctttttgattaaaagttcagttcggttaaaaagaggttttacatcttcttcagcccaatcgaacatgtcatcataatcaccggcatgacgcatattctgtaaacgagagaccaaacgcatctcatctttgtccaacaaccctttagttgcaaattcctgccccaacaaacaaattacaccgttatgggtcttagatctaaaacctttatctatcaataatgcggaagccatgtggaagacagcataatacaaacgatttgcaaccacattccaatgattcatggtagcattgtccgaagcttcaataaaaacgctatcagccttttgaacacggtaagcaataatagatttcttttcttctatacttagtggcataattcaattccctcctgttctacattcttataaaaaagagtgaaactccgtctttgccaatctgtataagtatatatcaatggattgatatccgcaccgattttccaacctaattcaaccagtggataagctacacggtcaaaatcttcattatatatgcgagatttgtccaataaaataagaatatcccaatcggactcatgatgtgcatccccacgagcctgagaaccgaataaaatgacacgactccctgaaggcatcacctgacgaaccgtttcacgaatggaatggataatctcatttttttgcataatggtattagcttaatatattgtatgacaaagaaacaaattatattccgcttatccaataatgaagcaattatattttagtttttttatgttatagtccaattttgacgtgtaccccaaggaaagccgccacaaggcagttctccaataattaacgtcaaaaaagatactgatttttaatatttgttattgctccagtccgattgtcaagggtaacaaatattcataatccctacgtcctttaacaatttcactgaaaaatctcttgaaataatcaagcacagacacaccctgcatcctgcaagtggagatgatggtatgatataccgctgagacgccggccatcttgtcacttccgaagaataacgagtgcttacgctcaccaaccaatggacgaataaaacgttcggcacaaactctattgtcggcactcatagtacggcaaaatactttcagcaccattataggttacctgcataaactggtatccgggtctaaaacgtctctcaaacatactgtaagaccgtcggtcatagctgaacaaacgaaccagacgtaaacctttagacatcacgataaagacatcaccatcttccggctcacggttcaactgctgatggatgatggataagaccttatcatatttacagcgcatatcatgaaaatcacgaacaaagaaaaaacggtttagtcctgtaatattcaacataagacctccagtttctccaccaagcttttcaaaccttcgtagcttaaatttttctgactaatatgaacaccattgctcatgcggatatccaccaggattcgaagttcggcaggcgaagaaagccgaggagccgattctggcttttgttccgggattagcgaaggactttccggcatttctgattccgtggagggagcacccaaaacctgaacaggaactatcttcctccggatatccttataccatttggaaaataggttataaggaacttggctggacatacaaaatttctcaatagaaacacccgcagggataccttccaatttatagcgcaaaaatagacgctcaaaatcattgtaactatacataaacttggcttttgatttaacgaaagcaaagatctaacttttatatcggttatcctatacgtcatttttggatgctaacgaaccatttctgaaagatgttataaggaaccttgtgcttaacacaaaacgattggagagattctccatgaggcaaggcctccgtctggtactgaaagtaaaacctttcaagatcttcactgctatacataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctccgtctggtactgaaagtaaaacctttcaagatcttcactgctatacataattctataaatttggttggcagcgaagataggactttcaattaatagccatttttgactgcttacataaaataggattggcaatatgccaacagttaacaagcaagttatttttttaaccattctgtgtataggcacttgaaaaagtgtttaggcaaaaggagatgccctaaattgagtgcttactaaaaaaacaatcaaagcatttgatatagaaaataactagcgttctcataatcaaacatctcaatattttgattatcgaccttacctgtaaaatagcattgagattcataatcaaatccttgaaattttgatttattccattctatagtaacatgataattggctacataatcaaaaagcatgtcaaaagctccttttacatgtccgtttctctgataatcaaatacatgaattccagaaatagaacgatgcataaccaagaaatgaaaatattcaccctttgaataatcaaagaccatttgttttttacgataaggattcactttcattccacaaatgaaagcgatacatgcccttttatcgtttgtcatctttataaaatttatagatgttactattgctatgcaaattcagaatcttctccattttacgggaagccgaacaattacatgtctctaaatgcatataggccaatgcatattcattatatatatttgtcatgaaaatccccgggtcatcactacctaacacgacagacggaagcaatattttttcttggtcaacctcaagccatttttccaaatgatattcttttaaatgttgatagtgactgatacataaattgcttgtaggcaaagcttcaataacaatttccttcctagcaagatattccaaaattagcaattgtataattcccaatgcatcagaactaaataatttatccgtttctatttctatcacttcatcataattcttccggctgtttacagtatcccccaagtacttccgtccatttgtcgatgcatgataagcttctataattggtttgatcccagacttgccaaactcagtttgtatatcattatactgttcgtatgaataattggaataccagctatcataacgcatatccgccttttccaaaagaagaaacggatcatattgcctatattcccaagctttgctcaacagatagggcagataatacgtcccatataccttataagaatattccgcaatctcactctcaagaggcagaaccagatgttgcaacccttcatgttttgattcacgtatcagtttccatacaaataccaaatcatccaaccactctccttgtggcaaataacatattttcccaattctccgtatccacaaatcaggtgatatgcctatcgccgtacaatgtcctaaacggtcgcccggccacaagtctaaaaaaatcacggcttctacaatagttctcagtccactcactaagtggctaaaatcctctcctgcatgaaaagtgaaatgtttcactccctggtttcttaaaaaacgatacgtttgtgcaaagacctccggtcctgcatcaaattcactagcagccgcatcgactcccactacatattgtttgttatcaggactttctttcaaaaaaacggccaaagcgatggcttttcttttcagttcctttcgcaggaaacgggatctgatattaaacttcttctcgaacgttttttccggacgctttatgaaatgcgcaatcaatcgcaaatccgtatccttcaaaaattccgattttcttttagcctcttcgaaacctcttcgtattctgctaaccagcaaactgttttctacggatgagttctttggagaaaaacggccttcgattaaagctagctttgtacaaaagttacatcctgccagctgtaaaaaacgtttttcataaaactcttcaatatgccacctaaatgaattttctgtcaagagctggaattgcgggaatcccacttgaagccgttgcatcaccacaaaccgatgaaccatgccttttatcaacaagtaatgatggaacatacccgccactttggtatcatgataattccttatttcactcatgacacacaggcagaacagcaattcatctatcatcatcccagtttcactcatccccccgaaatccccccacaaatttctcaatctaaccggagatgaataatctttctccccttttatgatctcctccttaattaagccattactaatagctatttgtgttatcaatctgccgcgcaagtccgccgcctgcttcatccgttcatacaatctgagaggtgtaaaatccgagattatctgttccgacaatttcctgactgccgctttactttcatacgcatcctgataatctttcgccatcttataaggactcctcaacaataaattccataacacatccgtctctgttgttccgttcaaatgaagatgcaagtcattcagtcctccttccttctccattatatagttaaatgccggtatgtatggaagtaactggaccgtatgtttgaactgcttcaagaaacagttggcaaactccatcattttcctcctgtccttttgtaatgccgatgtaaacttatccgcaaagaaagcggaaatcagtaacaaagggggaaactgctttatcagttccatccattctgtaaaacgatcagcctttacatatagttcgtgatttaccgatatcaaatattctttggcaaggtcataaggaatccctcctatcaagtccggcaaatcccggtaagccgctaatgcattctttgccaatccttcataataagaatcatgctttagaggagcgttttgtctttccagtgcaatcaaccttcgttgaacctgtcctatggacacctgtctacttgttccccaataacgttcatactcaaacaagctttcgttatcacacaatagttgagataatatcggaatcatctttatcagatatagattgcattcagaatagcaaagacaggagaatcagactgatgcagtgattcataattcgcttttacaaaatcagctacattttttatttttcctttcaacaagtttatttcattgaacagttccctaagaccaagttttgtctcgctcattttatttgatatatcatcttttatgaaatccacctgcatttcatccatgccattatgtagcaagacttctaattcatccacctttattatattttttgtctttttacgaagagtctgtttctctttcagcaattgctggtattcttcttcctccccaggtaacaaaaattcagacgtattgtatgttgacaatttttcttccacttccttcaattggataaaatactttatccactcttgaattccattataccttttcaattcccacaacacattctcctgcttttttagcaataaagccagtttattattcatctgatcatattttaacaattcattcaagtactgttctttctcctcaatatcattttgcatcaagtattttaaaaagggattcaaaaaaatctctagcagaggacattctgaaagccatttataaaaatcagttttaccgtttatcgtcattttagaagatgccgcctttctgttatgaatatagatggtctcaatatcccctattacattaaagttcatattgggaattccgtattcggccatttcttccaccaatgcagcattcagcagagccacaatatacgcattaaatttcataccggcacttctatatttatcatcctcgtctatctgtaacatcgtattatagaaccggataaaaatatgatagagtaatgatgtcgaaacctccacgctcatatctgctgcccactccttcaattctctaataacagtagtccacaaatcgtcctcctttatatctatggtgacatcgttccaattggccaatccttctttccggctcaccggatccaagaagaagggttgcaggaaattactatatggagcttctttggataacatttcttctaaactgtccgaaccgttgttcttactgtaaaacaaggtttctctgataatcgccagcaacctgtaaacagaaagaaaaacattctcatgttgccgagtatctattgtacccaacataggaagcatggaaagcacctgattgctttccgacagcaagacaggagcattgttgcctataaatatagttcccgccatggtttcaacattctcctgtttgttcctattcaacttgctgttacaaaaggcctgtgccaaccctacactcttcagtaaattgatattagcattcaattgtgaaaattcaagtaagtcacgtaccatactccgatccgacagctttcctcccaacctttcgcttaaaacctctatatacgacaaacgtatccaataatcaaaaatcaggaaacgattttttcgtaccaattgattgaatttagttccgacagcaaaaagagccttgttcaatatatcatcattggtttccggaaggaagttactgcctgtatacaatgcattagcatgtatcaggaacttcagcatttcaatagtatacacaggtgtcccgttaatcaacaatttagtatttgccgccttttgattgatgtcatttgcaaaaacattcagcagtcctgtagttatatccattttctccttttgggcagaattgaagttcaataaagtcaggatacgtacctgtcccctcaaagataatcctaacaggaaatggcatatttcagtattaatcctttcatttcccgatgatatcccgatacggttcaacaaatccttataacatttgacaatagcctttccctttttcgtatccgtatagattacttccaaagaataatcatcctcttccagatactctctgattgtttttaaatgtattcggtattccggtttcaaaagtttaatcagatattgattttccaattggtctatcatttccgcaaattcctcttttctatgtccggcatactccatttcctttttcaagaagtcatcatcaaaacatttccagttggcttttcttaccagtttgctataaagttccaggtctccggtcagtatggttattatctgcccggaagtaatgtactttctcaacacttccaatatttcaaatcctttcttaaaatccgtatcaatatcatcaaaaggaatcacaatacattttttatccagcaacttcaacgtttctctgatatagatgtggaatctctcttccaaattattaaaagccttggctttattcataccctgtatagaaatgaattcttcatcatcccatccgtcatatacattatctttacctatgccatcaataaaaggcaatgcctttagcaagtcattataacaatcagcatgttttttctgttcttcaaagcgcttgtctctgacggaataataattttcgttcaaagcgttttccacacattcctgaatagcggccaatatattgataaacggatgttgcttcgtttcaatcaatgaaggatctataggacttaagcataatatatcctttcccttgtctctttttattctgtctagaaaagacaataagaaagtcgttttccctgccccacgactggcaaaaacagaaatagtactatgaaatctatgaaaatcagtattttccccaacttctatggcattgtcatacaactgatcccacattcgcataatctgtctcattttggaacggtgtatcaggctctgttcgtcatagggtgcagcgtccgaataatcacacttggaaaaatctaaaactactttattctccatcttacaaaaattacggttaacagcaatagctataatagcttaatatcacttctcttatttgggttctggcatatcgtctggcttctatagcagacaaccataccgatgataacaatacagcgaaaatgacaatgaactcgagccatgatatatccttgttcagtccccattttaaatctatcaatacacctatagctactataaaagaaaaaatcaatccttcaaaaacagcctgcattacccacattctgttcataaagataatctgttctttggcttcttcttttttatgtaattcaatccacatgtaactataggctagttttttatccgaaactgataaagataaagcattagaagccaaagcattcattgttctgtcgtaggtttcttcaaaatctttatctgtattttgaactatttttcgaatcagtctcccgattatccaagaagaaagtccgcaaatgtatgccagaaatattccgcaaacaatagttatggatatgtttcgtataaagaactcatagtaatgataatgaaggtcaaacagaacgatacccaatgtaaaaccaccggaaacaatataggaaaaatccaatatgctgaacgcattggacagtatgtctataatcttctgaaaactaggcatagaaataaatattaattaagttatttcagatggattttgaaataaatgccgccggagaagtatttcccgttgttcagttcggcaataagattgatgtggtctttccagagttgataatgtgcgccgatgtttattgtgcgggcgtcgtattcggccatcaggtccagcccgttcaaagctttcaccgccaggttgtcttccggcaaaaggttgaatttgaaattcacacctgcggcaggctttctgtaatgagggaaccagcaggcacggtaatccacgtatgcggcgtgaacgcccagtgttcctatcccggcaaaactgaaatgcttggttgccgccagataatatcgtgtaaaatgattgttctgcataccgtcctcatcgaacttgatggccccaccaccgtatgcttcatgcgaggtgggatcgtccagacccaggactatctgtggagtccagggcttccaccagccttctttccacaaccgcaggcgagcattgaaggcgcggtcctgattggtgtactttccccaagactgctccgggaaataagtggagccatgctccgcataattgatggtgcaggtgtatcccacttcgagccaggggaagatggttatgttcagataataattgaatgtgtattttatctcattactactgatatattgcaacggaacaagatgcaacacattccctcccgccataaatgtcttgtctctttgcatctcggcagtgggagcatgaagaagtcccgttgtaccgtatagtgcctgtgcctgactctgtaacgagctaatcgcaataaggcatactaaaattaattgtatttttctacccatcatccctcttcatctcttccttaatcagtctgggcaaggtctttatgaaattccaatatcgaggaacatttttcttcgggtcttcaaaagcacgatgcaaccactccagtttaagtttcaacatccagttcggagcacgccttacatttcccactccagcattgaaattgaatatggctccaaagccaaacatcactccacgatgtaaataaggctgcaaacggttcatgaacatttcctgtttcggagcgcccaaagatacccaaataatatccggtccatcctcatttatcatttgcgcgataccttgataatcgaattcatccactttccggaaaggcaaggtttcaaaacgcatattctttatttcaggatctatttttgaaagattatctttcagtccggaaagcacttcctgagtattacccaaaaaaaactggcgatattggcacatccgcacatattttataaaaatatcagctcctatatatgactctaaaggctcgtgatgaatatatcccaatattttggcaagtacggatccgtcacaattattgactaaggccccattcaacacgttcaaaaactcagaattattattggcaacagtcaaattattactctcaaccgaacagacatatcctaccgttccctcctttatagcattttctatggtttgctctaattttctcttatcaaattctaaacggacattaaaatatctcttctctttcataaaaccactcctatagtcataaatttcatcaccgaacaggcttgcaggctatgcctgtaacctgccggaatcaacagatacgtcccagccttacagatatacttttcatcaactatcatcataagcccttctccttccataaaataatagtgctcatccatggtaggatgcacatgagtatccacaaaatcacctttatgtaattctgtaatcgctatttgagtaagagaagaagaagtttcctgtgaagaaagaagaacggttttcaaaccgacatgatgggaagtagaaacgggaagaatatctgaaaaatccttttgaattattgatggcatccgcttttttcaatttgggatttcacccattcatattgctgcctcaaaccatcctccaaggctattttaggctcccaacctaatattgtttttgctttggtatagtctgcgctacgtgccttgtctccttccggcttggtcgtatcatagactatttcaatatccttaccggatatttttacgactgtctcggctatctctttaatggaagtacatacggaaggacctatctgaatataaccatgcccccatcccttttccaaagccagacaaagagcctcgaccacatcgtccacatgaatgaaagcacgtccttgcaaaccactgccccatacattgaacggctcttcgggataatttacagctttacggatcaaagcaggaatcacctggcttctttctccataatcacaaggaggaccatatacattatgaaacatcaaagtacagcagggaatccctatctccttttctaaaaatccaagttcaatctgtcccatcaatttactccagccataagccgattcaggaaaagccggaaaaagttcctcttcttttaaaggaaccacatccaaagaattttggcgtgtcaaaggaaaactgcaagccgttcctacgtatatcaatcctttcacacggtctttccccgcttttcgtacagaattgaatacatgggtattaattagattattcaacctgaacaattcaccttgatttccaaaaacataatcaattccagcaacgatatcggccaaatgaatgacgtaatccatattgaacacaatacggtcacattcattccctacagatagatcgatgttaaagaaatgagtatccaaatcaatgacaggcttgcccgcttcatcattcaaatactctaattttccacgccacaaattatctattacataaacatcattaccttcttttacaaggcgttttaccaggttggagcctatcatgccacaaccaccggtcactaatatttttttccccataattaatttgtatattgtttgataattcccaatttcatcaaatacgtttttaactttcctaaaacacgtgctttcactgaataataagaataaaactgcctagcaatacatttattttccattagcataaaggaaaagttaaattgctcttttccagacatatcaaaatccacacgatatcgattataaacacaacaatgcgtagcttcagaagtaaatccatcatttattacttttgattgacatggatataccgtcaacttattttgtttaaattgattataactaaatcttatccaccacgaacttatacgcccttccatacaagcgaataaaagccctgacatttcactacctagttgatcaaattctttttgattttttttattaaatctaaactcattccaatctgcaatattccaatctactgtttcccaacgatctgaccacgtaccccatccccaacaatgagcttttcgagccataaatgaatcataggggtaatcccaacatttaatttggggagaaaagccagacactgagaaaatattattttcaaattgaaatttaaccaaggcttgattcatccaatctaaaaagtttgacgatacgattaaatcatcttccaccactataactttgccatattttttaattattaaagttacaccttcaataatagaagaagctaatcctttatttacagaagaataattacgctcaatttttctaaaccctgttatagtatccagatagttcctaactgtatttattataatcaaatccttctcatttttcggtccatccgaaaaaatatataaatcagtttctcttgacaatctatttttttttaaagagtttatagttctctgtaaacagtctaatcggttatacacaaataatactattggagctaacataatatacaattttaataattagaatttaaaagcactacagatatataccttatgaataaatagcataagcataaaattcacaaattgaaatatgacgagataggtgcaattatagaataatttactttttcatatacccaagtaccatgagatatgtagtaagtaaaaaatagaattaacaatatagacatcactcccatttgtacattcgacacccttatcatcttgaagaaaaatgtgcttgaaaatggtaaaagaaaccaaataaaaaaattaaatcgaacagagagttccaattggtgtaaattcaatattataaaaagaaataagaaaatgaatatgtgaacaaacaagtatcctccagaaggtttactacttaacttatcataaaagtaataatagtaaaatggaataaacactatacaaaatgaaactattaattgcaacatagataaagaagataactcaaacgttgtgttttgggaggttcttttcaaaatatatccaacaataggtatattttcaaaaactacatataaataagaagataagacttgatacaaagacaaaagacaaaaacataagataacacaatacagtcgttttcctaccaatctatcttttaaaatcggtagaaataaaaagacaacaaaaaaaagcgtagtagtatgaatcaaaaccatggcaataactaaccaccattttttgttgttataaaagcttgtatccactaataaatagaacaataaagaagtagccagtatctgtctcactaaatgggctgacattataaataaatagggagtaaacatcattatgcatatacaaaatattataaccttataagacagttccaacttaaaggccaatttaattaatgaatatgctaaaagtccataagagataaaactgatacaaaaaatatagacctttgtgttacttccgataatccaatacaatatataattaagaactgaaaataacggttcttttatagcctctccttgcgataaaaatgttatataagtaaagaagtcagtatagttaacagccttatagtagtctaaatacatttccaaatcattgtctggaacttttgttgcatttatacaagaaatataagcagcaaatataaaagaagataaatacaaaaaacttcgatgggtaattctggaagtaataaaatacagaaataccaagaaagtaatagccactggatttaaacaaaacaatattaatcccactaatacaattcctttagtagatagacaaattctattacccatataaaaactcactttttaaatagattcttatattgattatacaccttatctggaaacacaacaataattatttctaatagcactttatatatggcatagataatattgaaattctttttgtaaaaatagaatgctgtttttaaactcaaactcattggagtatttaaatagcgcaatctctcccttatgcctacaccggattttctaattctatttgttccgttttcattccgagcacaaataccaacatattgtgaagcaacaaaaactttaaggcctgcatgccttgcaaccagtccatagtcataatcacctaaatgatgccaataatggctatctaagatgcctatttttttatatacactatacgggactaatacaaaatttccattcatgtaaaacaattcctgtaaagtcccgttaggaaaaatcggacagccgtctttagttttacctccataagaaaatgttccattctctgtattttggaaacttccacaaattatagaatgatttcctgcaagtaaactatctccgatcacgacattcaatgcatcattatacaaaatagtatcatcattcaaccaaataaagtagtcgtaatagtcttgctttattgcagctttccaagcctctctcataccccgattccaaaacaagttgccactaccttgaataagaaaaactttattataaaataaactaacgctttcagatgtattatcagtagacccatcatcaactaaaaacacatcaatactaaaatgatatgaattatccaaacagtatagagaatgcaaacatctcaatgttttctcacagcgattatgacaagtcatcaaaacagcaattttcatgatgcgtaatttaaagccttcctccaattttaacatatcccatacagactcagcagccgttaagcggtcttcgtatctttattactttgcatggatttcctcctgcaatacagtctgcaggaagggattttgtaatcacactgtcggtaccaacaattgtacggcaaccaatggtcaccccttttaagatgattgtacctgctcctatgaaacagtcgtcaccaatcattaccggagcactattacggtgttgacgatcagctttcttgcagtcacggcgatccatataatttaaagaatggaagtcggaagaatagattttctcccctcccactagcaatggtaagtgctcaatttagggcatccccctttgaaagggcacattactatgccctacactgaattttgttaattaatcagctttgaatttaacattggcttgtagccaaagtgattttgtcaggaactatattaacataatccctgcatccattaaaaatcttttaaaaaaatgctgaatcctttaacagttcactttccaacaggctgcgtaattccatcaggagttccttcgtttccatgctttgcctttcacgcaacctttcttgcggagtaagcccggattcatcatagatatgttcgcgcaaagaaactctttaaaaggtttgaaaaacatccggctgtcggtccatcaccttgattggcagctttcacgaacttgttgtttacatgagacatgcattccttcactataatttataggattccgtgagcaggtttccctgctcagcataagccctccagtttctctatcatccgaactaaatcctgatagcttaaattcttttgggataaatgcaagccgttgcttatacgaacctcaatccaaatacgaacaggagtatcgatgctgcctttggatacagtttgagggtgcatgacaggcatgggatttttctcattacccgcaacgggaataccatcaatctggacttcaactacttgtttactagtatccttaaaccatttgtaaaagatgttacaaggaactttgttcctaacacaaaacaattggagagattctccatgaggcaaagcctccgtctggtactgaaagtaaaacctttcaagatcttcactgctatacataatgataaaattttgcagcgaagatagaacttccaatcaatagccaattttggactgcttacgaaacagcaatatgtcatttttggacactaacgctctatatattttattactttacacggattacctgctgcaatgcaatcagctggaatactcttggtaacgacactgccactacctatcacagtacgcgcaccaataattacccctttcaaaataatacaacgagttccaatgagtacatcatcttcaattatgataggggcagtagcagcagctaaaccatcaactctatacccttgttcattcttctctattgacctacgaatattaaaattaaggctatgtgcgtccgtatccataataacacaatcaccaccaatctttacataattaccaatcgtaatactagtactagcccataaacaagccgaagatatgccagagttatcaccaatagtaatacgcgatgagggataaactgtgaacatacatccacaaatatttcgacacaaaggattaaacgcctctccactggtaaatacaaaattatcaccaattgtaattttactacttcgtgccttattcagataaattttattatatacccgcatgttgctaccgaaacgcacatcattcaaccagaatttgaagcgattaaagcaaatataataaatcatgtgtaaacgtcgaggtatacgcagggatttggctaaaaaggatcttatattcataaaatttaaacagatttgcaaatttcaagtcctaatggttatttcatattcgaggtctttggtaagataggaatggctatatatctgcatattcagtgcggtacgattattctatatgtcactttcaattgccaactaaaagagaaataaattctgagatgtttaacttctttggatgataataaatttagaaaattacaaaattgcttgtttagtcatctctacatattttctaccatatttcagatctggttctaaataattaccttctccccattcattccatgatttaacaaacaataggttttcttgctgcgaccttgtttgcagtttgttaaacatctgtcggcacaacttcccccacttttcaggggtattcccgactataatacatccacgatgtgcgctacgtggtgaatgatcaaaattaggcaataaacacggatgaatattagatcctaattgatattcactcaaaacacagtccatatattgttcatactccaacaatctaggaattttcaaaatttttctctttattttttctaaaaatattttcaatggaaatgtatgaaaagcataagcatcatatatataatctactgttacactatcaaaaccaagttctaaaatagtcttgatattttttacaccaaaggtaaaaccgacaaaataaaatccagctaatccattttccttagccagacgattccatatctcaataaaaagcttcacatcaggtatttctaaaggagcataaactgcaaaaagtaatttcccatcgacttttatataacgagaatctttaaaagctggaagcattgcattgaaatgagctatataatcatcaatgcctgaatatgtctgttctattaatagtttattgggtttatcggggtcccaagtcttctgataccatgaatgatttgcccaacaaagacagaaaggaaagttcggtttaccactatcaacgacttcggtaaatacccgatcaagcaacctacgcccattaaaccaataatgccaataacagaaaccttctatacctgcctcttttgccatttctgcttgttgaattctaaccttcggtattctcaaatcataataccctaaatctgcaggaactctaggctggtaatgccctttaaaaagcggctttgcccgaccgacatttgtccattcagtaaatccttttccccaccattcatcattttcagtagtaggataaaactgcggcaaataaaatgctattaatcttggttttgacattcttatttttatttaagccatttatactttatctttcctatcgtcatccagtcgcaaataatcaagttcactttctttcatgcgcattttctcaggatataaaatcttctcatgtgcaataacttgctttgaattgaaacgaatacccaaaatatgtgcaggaactccgcctaccacacaataagcaggaaaagaagatataacaaccgcccctgctgcaacaacacagccacgaccaatattaactcctttcagaattgtaacattagcaccaatccaaacatcatcaccaataattacatccgaatcatcttctggaagtttttcatgattatcaataatagcaacacctatttttctaatattatgatcaccatttacaatcgtaacatgaggacccaacatcacattattcccaaaaataattttcttatatatagcatataatactgcattaggaccaattgaaacattgtcaccaaactcaatcattgaagctgaattaataatgcaaccattaccaataatcacttttttaccttgacgagcaaattgatactttctatgcctaacaaaaacatatcgcagtatatttacaatttttcgaatcataattctatactcaatattctcaataaatatgcaatctttttatcacaaattcacttatttttttacgctctgacttgcgcaaacctaacatacatatcataattagagacaatataatgcaaaataatgaaacagtaagcagataccaaaagcctgtgtctgaaacagatatattagacaatgttagaaatgacacaccactaataacgatcacaacagaaaaaggataaaccaatgcattccacacatatttactaatagaaagtcctatcaaaatattacaataataaactctgataaccaatactagcaattctacaactacttgaacaataaaaacagtagtaggactatactcaaataagagaaacaaataacatattggcacaacaaacaactctgctatgccactccaaaagaaaggttttccaatgtttccttgtgatcttaagccaacagtcaacggagtttgcaaacatgttagaaaacttccaataattgtaatgcgtataaaagacgatgtatattcaggaacttcaaccaaccataatgacagaatatcttccaacctcatatataccggtaaaacaattatgaataacagataaatagaaaaccgagagctgtttattattaagaatagcatcctttcataatcattcattgcataagacttcgtaatctgaggggttacagacgtttgaagattagtactaaattgttgcaaagcagaagttacctgaacagatattcctctagccgcatttactataggagagaagaacatattcaacaacatatttatcaaagatgtattaatcgcataagggatatgagcaaataatccccaaccggctatacgtaatatttctttatgcaaagcaccataacctacaaaacataatttagactcttggaattttttattacaataagcccaatataaaaattgactaagggtttgtgcgacgactatcaatactccatataagattagtctatccgaatgaaaattatctaccacataacatattacaagctttaacaacacatctactaaagaaatataagcaaatgcattcattttttcatgtgaaataattaagccattatatggaatactaataatggataaaaccaatcctaataatgataattgaaaacaccagttagcggcaaccaatctgtctgccggaataaccattttacaattaagcaaccagacaccacaggtttcacataacacgacaataactaaagcaataaaaacatgaatcgatatactaacattaaatacggtatttagtcgcttataatttcgttttcctaattctatagataaatatctttgagtaacaggtatcaaacatgagttcaaaaaagagaaaagagtaactgcacttcctacaacattatatataccatagtctgtaattcccaacgctttcaataaaatgcgacttgtataaatcgtaatagccattattaaaagcattctaacataaagaatacccgtatttacagctatccgtctattgtcatttctcatttaaatggattttaaagcctagttatctgagcaaatgtatattccccatactatataatatgggagtaataacaaaccttttgattagtaaagctaaagccaacaaaactataaaaaagataatatcaaagagcagtaagccaaaatatgaatactcttgataaaattttgaagctatcgatctccaaaactcagatatgcaaggaacctcatgaatcataaaaactcccaatacagcagatgccattgaattaatccagtgactttgaatcttaattcgagaaaataatataaacactgccatagaagataaaataaccaaaggattattataccccataattctcattgtattaattgtattcgattctttatgcataagtccaaagaaaaatacaaaaatacaaaccaataatattgtagagattgcatatacagatatacaaagaatcattggtgattgcatattccatttatttatcctaagccaataccctatcagatataaaaaagcaaaattagccacgttatatccatttacattattgtattttaacccccatccaaaaacaacattaagcactgttaaaagaagaatgaacaatgtgcattcatcaatatttatatttttacatctaaagagaggaagagatattattttattagttctaatcaacttattaagcaagggtatagaaaacaggagcattatataacacacaataaaccaattccaagtaaaatctatagcatgaacgaaatcgggaatagaaaagcgcgtaacattaaacaaactcgcaattaagtatgcaattccactatagcaggtcacttctataagtaaaaataatatctttcgaaagatttttttatccgacacaccaaaccatcccgtaatcaacacaaacaaatttactccaataattacagcactatttaacaatactcccgtaattccctcattcaaagtgtaatgacctgtatacccaaaagtatcagcgacagctaatgaatgatgaatcaacaccataaatatagcaacaattcgtaataattcaaactgagactctctagtatttataagattcatattgctatcaaattagtaattaataattgatttagcaaaaagagactctaaagattttattttattcatacaagattcatcaagttcctcatcattggaaattgcttgataacaggccttatttagatttacaaaatccactctttcaccaaactccttcactgtacgtaaatatgaagcacatgattttatattattcaatggagatacaaaactttttaagattctaggtaaatcttcaaaagagtcgaccctatgtataccttctatgagactaaatggcacatttgaaaatacaacagcatgtttacctaacattgcagcctcataagctgcagttcctgacagcgtgacaacaccttgagatttagtaatccaaggtttcgggtcattataataattaagctgtaccattttagcatttggaagtctattgactgctttataaaattctatacttctttcacctatcattgcttgatgctcttttacatataacatccagccagccggaagactcttagaaacagcttctataacggataattcattcacatagaaaggtgtcaaaatagaagttgttgattcaggtattaaatgtaaaggcatataaacatacctctcgtcatttcgaggtacttgaaacatcttatttcgcctcatcaaacgctgtttataatatgtgtaatgaagaaaatatttaatatagcccattgttgacggatacaatatttgattagatctctttattttccaatttccggcaataacatcctgtttgaacagtaaaataataaaatgagcccaaaacttcacgaccttcaaaaatgactccggataatactgataatcaatagaattgacagatgatttattcttaatctccgctttcttacgatagtcttctacatacttaacctccgttgaaaggtcaatcttattaccaatctcacaacttttgaaatattcttcaaattttatattaacagaatttcccaaattataagtgtatattaaataatcatcaaagcgagggaagtccaaagttacattaggaatatctctcttgtagcaaatttcacgtaatgcattgcgagatatttcgtccgaatccgtattgataacaacatccggttgaaattcatctaatactttgagtgcatctttataacataatatcaaccaatttaattgttgttgataagtacaagatgaccaaaaatagcgataatgataatgcctattaaaactttgtgatgaaataatctgagtgttaatattcttaaaatgcgtgtattctttttctattttttctaaaaaaaattggtcaatcacgttatcatcattccgtatatttataaatatttcagcgatactattaacatcatatacttttaaagaaatattttttttaaaagcataataagtgctttcattagaagggtttttcttaaatccagactcacttgccttgataaaatacgcagcaacttcattgtatttcatccagtcttttattaaaaaataaaaaggacgtgaatcatcctccctacaagttatcaatattcgttttcctttgatttccatttttttcaacttatagtttcattgaaaggcctattatcaatattgttatataaaaattacgactgtgctattgccataaagtttttaatacttaaaatgcctcactaaatcattggctttctgatactcctgaggagtgcctatatctatccaagttccatttagaggataacgaataacagacaagccacggtttatcaataattcaatgaaatctgtagcattaaagaattccccttctggtatcagttcaagcaatgaacgcttaaacaaatatattccggcattcgcataataagtatatgtaggtttttctatcagcccatggatattacggtctgccacgtcaaatattccataaggaatagacaccttataaggcacagccgctacagacatgtccgcatgatgttgagtgaaatgcaaatagaagtcttcataatctatagtcgtaaaaagatctgaattcataactaatacaacatcattatagaattgtttcacaaacctaatagaccccatagtacccaaatattccggttctaaagccgtgtctatctttattccatcaataggtttgctaaaatggtcttctatctgctcgtgcaaataattcacagtaacattgatgtgcctaactccatagttaaccaagcgctctatgttataatctataatggctttatctccgactggaagcaaaggtttaggggtcttttccgtcaatggacgtaagcgttcgcctttccctcctgccatcataacaacatctatagggaggacagagcgaagtttctctatattatatatctcctttatatgatgctccgaatcaagtactggtattaatttgatatgtttattgcgcaattcatgtatatgtgaaacgatattcaagtcattttcatcaatatatgcaaactcacaaaacatcacatctcttaccctactatccagttcataattccctatcaaagcccgacggatatctccatctgtcagtgtaccgaccatacatccattgttatctacaacaaaaagggtcattgcagtgtctgataaatcattcaaaatacgtaaggcatctacaatccgaagagtatctgcaattatacattcctcattcatagctctatcattttttcctttattaacagctctgcaaatttccagtcaagcatggtatccaaatccaaagaatggagttcatccacctctaaggctacaatttttgtaaaagcatttaaatccttacttcgcaaagatctgacgttcatgacatacaccgatcctgtaaattcataaacttcaggagcatcctgacgcctgattattctaccatctcccttagactggactaaatatccgtccttattcaattcaaaacaatcataataaggatttgaagcagcttcttttacgctaaccaccatatccacatcagcagtatacttgtctaggcaagattttacatcatcaaccctacggaaaggagatgtaggttgtagcaatacaacggcatcgtactccttaccctgcaaagcataataatctaaggcgtgaagaatcactccataagtacttgcatggtcagaagctagttcggaaggtctcaaaaaaggaacaggcaaaccataatcctccacaacacgctttatttccgcatcatcagtcgatacacaaatattcctatcagagacaacacttcgggctatatctatactatggcatataaggggcttacccgctaaaaattttatatttttatgaggaatacctttacttcccccacgggcaggaattattattaaaagattcattctgtttatctaatttgaataggttcgtctacatcatagttctttgttgcccgttttccaagaatcaagttccaataagaagcacttatccctttttctgctctcttcacagtaagattatctacagacaattcctcaccttcttgaattcttctcttggctacaattgatttcaaaacaacctttgaaatttcaatctcacttttattgggtctttttataccatctcctaaagccaattctatattacgaatacagtctaccatatatttcaattcagcaggttcaagcgaagctttatgatcaggtccttccatctttcggcttaaagtaaaatgcttttctataatttcggctcccatagccactgctgcaataggtatctctgcacccatagtatgatcagaataacctattttacatttaaaggcatttttcattgtctgcatggcacaaagattcacctcagacatggggcaaggataattggtggtacaatgaagcaacgatacactattcgctcctgcctcaagcaaagtgcgatatgctatttccacatcactgagccaagacatacctgtggaaagaatgacaggcatcctgcattgaccaatacgcttcaaataaggtatattgtttacttcacccgaacctattttaaggaaaggaagatgcaagctgacaagaaaatccagactgtcttcctcatcgggtgtggaaagaaaatcaatgcctatcttgtcgcaatattctttaatttcgaagaactgacgataactaagttccagtttcttcagcatatcaaattgcgtttcttcgtttgaatgggtattctccacctgataagtggcttttgccgctgtttgagtaacaatcttctcagtcttccaagtctgaaacttcaccgcatccacacctgctgccttagcgacatcacacagacgtagtgccaaatcgagacgtccattatgattgacacccgcttcggctatgatatatacagccataatctcaatatttatatttcaatagaaaatacttataatgttcctttttatcaggattccttacctcccaatcagcacacaacgcctgatagacggtctcattgaaaagcaatttaccgatagcaaactgacaggtgtttcttgagaaacggcttttgaagcagaacagagaatcgtcctcgccagatgtagtgcctccaccaagatgaaagcgtctgactccccgacgcttcaattccaaagcggcattatagagcatataattattgggggacaaaccaagatatgccttgtcactgcctgacagatggtaatgcccataaggcggatggcagaaaaagatggcagcagaaagcacctcttcctctaacttcacaactcccaaaaacttattatcaatgcgctctttcaacgaccgataataggcatcattaaaataatagaagccatcggcagaaagcttgtccatcgtagaattatacaatctggcaaactgcggcaaataagcgaatgcgtcatcaaccacaaacttcaatccattcctgtcaccttttttaatgacattacggttcttggtatgaatttcgttcatccaaatgtcattttcatcaagagacagatccattgctatcgtcttacggtcaaaaatgactttgcctatactatcgaattttctgtaattgtctaacagaggatgaaaccgcacaaaacctgccacacaaccatgatttgaaaactcctgagaaagactcctcaaagctgcgacccaaaaactttcgttgttcacgttacatatcggtccaccataaccataagcagtctcaaaatcaaaaaatgtcttctcattgtacgtaaactcccgtttgagaaaagggaaaagcatataggagtcattctcataaatcaccgcacaataaggtttttctgtaggtgtttcatagagataaacatattcttccttaaaatatacatcatactgttcattggaaaagtaactgaaataccggttccaatgtggagtaaatagaatcttcataaacagttttttctgatgaataaatattgataatcaaaatattagagtaatatcatatctgttttaaattcattatcgataatttctctgcttatcattgagatagtcctttatatgctgcactatttgttcggaagcatgtccatcaccccaaaacttatcaattaaccggtaatcaacaatatatgatatagctttctctatttcctgctgtgagatgccacaacatatcacgttcttacaaatatggcgccctttttgacgattaccaatattaactactggaatacccaagaaaggagcttccacaatgccggatgatgaatttcctaatacacattccacttgggacataaaactcaaataacgcagttgccccaaggaagcaacaacccttacatcgtcatcttgttttgcatcccaatatttattgatctggctcccaccaaaatcggcattagccttagttactacaaattgtacatttttttgtccaatcattacattatagaggttctcagtcatttgcaaattataatcaagcgactccttggtttcgctatgaagagtaacaagcatccattgtttacttgcattcaaattaagttgctcggccaattcactacgtgtcatcagttgatgacgaagaaatgaatcaaggcccggttcacccactacatatatattttcgtccattcccaacatacgccgcagacgtactgctgattcttcagtgccaggaaaatgcagtgaagacatcatagtgacagcattacgtacctcattgtcgatagccccttctgtaatgtcaccacctgaaatatgcgcaatagggatattgaaaagaagagctgtgttgacaattggaagcaactcgtagcgatcgcccaaaatgacaatcatatccggcttcaagctacgaaacgcatagcttatcttttcagcacaaatccccatagaacgtgggatagaataaaggtcttcagtatgtagttccatatctatcttggcatctatggtatatccgtcatgctcaatgaaatgataggtcatgccaaactctttggacagatggctacctgtcgccactatttgaagattgacgtctttgtctttcgaaagaatgtcgattatccaacgaagcagaccatactctgagcgagtggctgttactacgcaaatatttttcatacatgtcttatccacaacgagaataaattgttttgagaaagaaaggggtaattcactatattcttgctcctaaggctcatgaaatccattctcggaaactaccatcctacttcctatatttttaattgaaatcaaaacggtcatcaataatagaacgttccatccatagccaacgcatagccataagctatgtgaaaccagcttgattaaagccagcagtttgatttctcacccttacttttggttcaggataagaaagtaatttgctacagataagacgttgtctctcataattctatgatatgttggaacaaaattgcaattctctataaaatcgccaaagaaatttacttattcttgaaaattattagttctccagccttacactactaggaatattcaccacccggtcagccagccactcggtattctccagcccgtccgtttcgcaatgctcgaacatgggcagtcgattcatcagttcccaaacgggacgggtcatcacaccatgatcatttgtgtactccaaaaaatcaagttgagcctccttatcctttagtaccaccgcattgagccaataattcgatttgcaatcagcaggttcagtaaagaaagtaatatcttccttacccttgaaaaactcaacataacgggcggctgtctcacgcttatctgccacatagcggtctagattctccaactgggcacaacctagagcggcattgatattcggcatccggtaattataaccaatatggtcatgacgaaactcccaacgatgaggtatcttagcctgggtagtaaggtgcttggcgtatgcgcccagttcttcatcctggaaaagcaacatgcctccaccacctgtagtgatggttttgtttccattaaagctaatagcacccacctttccgaatgtaccggtatgataccctttataaaaactgccgatactttcggctgcgtcttcaaccaattcgatatgccactcacggcagatatccgccagttcatctatttttacgggatggccgaaagtgtgcatgggaatacaagcttttacacgacgaccggtacgcttgttatagcaaactccttctttcagttcagcattcctctccagccatgccttgacagctcgggacgaaagtcccatcgtttctttgtccacatcaataaaaacaggatatgctccgatataactgacagcattgcaggtagcgatgaaggtcagagcttgagtgagcacctcatcatcgcgttctacacccactagcagcatggccatgtgaagggcattggtaccactcacacagactacggcacgcttggcaccggtgtacacagccatatcgtgctcaaagcggtcaacaaaagcaccgacacttgacacgaaagtcgtatcaatacattcgttgaggtattttttctcgtttccgataaacttgggagcactcagaggaacaaaatcttgtgttccaaaaagatggtgaatgaattcacagatttcagcgttgttattcatagctgtatatcattttaattacattttctgatctaaattcttccccttttcctcatgttcaaagttggggatgaaacgctttatcgccataaccacctcttctttggtaaaatccggttcggcaaatatattctccatttcagtaaagaatgcatctatctcagtcatcggccgtttcactacttcctcaatcacccctaggctgcaaaaacgatccatattaattttctcaccagaaacatagaactcctcgtatgccttctcacctgttgtatcacttttaaaatacaccactgggtaatccttattatcaaaagtcatatccgaagcaaatttcttcgcttcctcatccgttgcaaactcttttttctcgcagccaaccgcttttatatactcatcacaaatggaagagaaagtgagcatctgtctttcacccaactttgggaagaatatttcaccattcttacctagtatgcaggcaagcatacatatctggccgctttcctccggagaaacaaagtagcgtttcacatcattgggtgcagccaacggctgctttttcatgacacgctgtatccagccatccggcaaagaaccgttggaaaaagccacattggcaaaacgggcggtggtcaccttgaacttggaagaatacgccattatcatatcttccatgatgcgcttactagctcccataatgttcaccggattggcggccttgtcagtggaaacacagaagaaatgcctaggcgggtaaacggccaacaggtcaaggaatctttttgccttgatatcattgttttcaatgagtgcctgtaccgaatatttgtccttctcactacggacatgcttgtgagccgaaaaattcgccacaatgtcaaagcctttctcctcacggaagatcctttcaaagataggatcggcaaagttcaaggtatatgcccgatattccgcaggtacatacatgccgtatgtggaacgcaggtcacgtgtcagttctgccaatccgttctcgttcaggtctattacaatcagtttggagggcttgaacggcaagactgctttaatgaaagaagaaccgatggaaccggcacctcctatgacgcatacacttttattccttatttctgcttgaagcgtttctttattagcttcaatatctgctgcaaacatacttgtcggacgacaaatcacatggtctgcaatgaattgctgtaaattaaacatggatttattaggattagcatctcattttgacacatcctataaagaaaaccgcattaaagcagtttccctataaattgggtcaaaaattggattatcttttaatgcttatttaacgaaaaagtaagatatattcccaagcaaagtaagtagacttaaacagcaaagtaagtgaacttactttgcccacgaacatatcttacttttttccacacttatcaccggtttttcatctccggtcataaccgctttctcggtcgtcttgcccaagcgttattgatacgcgcacggatattgctgacagtcttgcccgatacgaacaaaggtgtgagaggaaagaacaacgagataaaacgctccttcaccatctcttccgaagtaatcttcggttcccgttcgcccatcttaactataaccctggccaattccaccgcattggtacattctgctatctgtaccagatagatacgtaaatcctccaccttatttatataagagaaaaggcgcatagcctcgggagataaagcaggttccttgtccatgcttacatcatccttctctagttccgcctcatcaccataataattctgtgtggcggaagtagcattgggaagaatctggttgctgcctccataaatgttgaagacgatgctgaagtgtgtctcactatccataagcttattgtttgaatgattcgtcaacgggtagttaacggtcagtcaatagctagtgaacggcagtcaacagttagtaaacgataataaatagatttttttacggtatttccccgcattaattttgtcgtgtcggaaggatgaacgaacatcccggaaacacaaaacttttaaactttattttattatgattgattacagtgtatttatgatgggcaacccgatggatgtcgatgccgcccaaaaagcgtatgcaaaagctcaagtttctgaaatcatgccattcagccagtttgtcaaacacattgccgaccacaatggcgtattcactcgcggaacggtaaaaggtgtaatagccgatatgtgcgagtgccttgtagaaatgcttctggaaggcaaaaaagtacaactggcagaattaggtaatttctggatttctataggctcggaaggtgcggaagacctgaagaaatttacagaaagcaacatcaccgccgtcaacattgtgttcacgccgggagaagacttccaaaatcttcgttcccgcgccgctttcaatcccgtagcaagccgcatagcccaagccgccaccctgaaggccgaaaaggccggtaaaggcacagtcgacttggatgccgccaaaggaaagaccccggcttccacaaatgaaaacaatccgtcattatgataaaataccacgttttctcgatgagaaatgcgtccgacaggacgatgcccaagaaagcatacgcaaagtgtgtgcccaacgaaacggtttcgcataagaaactcgtaaaggaagtgacggaacatctccgctttttcccacacggcatgatggaagcggtgctggaggaagtcttcaaccgcctgtccgagcatcttgcccaaggcgaccgagtcaccctggacggcctcggaacattcagtgtctccctgaaatgcgaaggagccgcttcggaggctttgttctccaagaaaaacatcaagggcgcgcacatcgtgtttgccccgtgtcgcaaactcaaggagacatttgcagatatggaatataaaatgactccacgaatcttttaacgtcatggaacttatattattcatctatttaaagacaaagcgtatgaaaaagaactggaaaaatgtactgctgtacatcgtccgcatcattgagctgctcattacaggcgctgccggaggagcacttggaagcggcttatgagaacggtttcgttgattatcgtgcactgctctgccaacaaggcgggcagtgccttgcgagcggaggacattgaccgctaccatcgttcattgggctggaagtgctgtggttaccactatgtgattcctacagacggaacgatagaagccggacgcccggaagagttggttggagcacattgcaagcaccacaacagccacagtataggtatatgctacataggcggactggatgatggcggaacaacgccgaaagacacccgaacggaagcacaaaaggctacgctgagaaaactgattgaacaactgcatcaacgttatcccaaggcactgattgtaggccatcatgacttgaatccgcaaaaagcctgtccatgtttccatgtcacagctgaatatatagacttgcaaccttagttgcgtctgtagtcttatctgccatccatcgtcctgcaagggatgtatggatggctttaattaaactaatcaattttttcaaacggaaacgcatgaagatagctcactgccaccgtcatattgccaaaagcgaataccagccttgtattgcggtgcaaacgcatgatacatccctctttcccccgaaagacaccaccggtaatacggattcgttgctttttctgaagatagtcctccaaaggccggttcatcagctcgatattgtaaggcatggattcatacagataaataaattcctccatctgacgttgaggaattaccgccgcacggtgtgtgttatagtccgtcaccagatactggcggggaagcatggcagacagaatacattccaactgccccaagggggcacatacaaacagccaaccgttgccttcaatccctttctcgttcgtcaacgcattcagtttctgagtggagccggtagcaaaagcctctttcaccacccgggcagagtcacggcgagcggtatattcctctttggtataagcacattgctcgaaacgtttcctatgatcggtggcagtgtaagaaaacaccttgaagcaaaaaaatctctcttctacggtacctgatggtgtacgaagccgaacagctttcctgccactgaaaacactgatatagcgtttcagttctttgttggaaagatacagataataccagccgagttcagggtattcttttcctattcccgccattggcgtgattccttcatttgaccccaggtctgagccggaagcgattgaactgcagagcagtaacttaggcgcttcgcccgttatgtcttgatttgaaaggaacgcttgattttcaagctccatactattttctgttaccatcaaaacattactttttatgtatgtctttttggggttctcttagtaagagaaccccaaaaagacatatactgctgacaataagatatttacacataatcagagatggataatttgcaaacaaatatcataagaatccttatcagagactgattcctgaataaaagatttccgtatttggattattatagctacatttgcagcggaatggggttctcttactaagagaactccattttttttattctaacagattcattttcaagatagatccaagaaagaccaaaaaggaacacataaattccttttccgcactcattaaaagaacaaatgataaaacgcaaaagcggccacttacgataaaaatcgaaagtgaccgctaaaaagagatttatttctctaatataaggatctaacagtacggagttacttcaccacaaatcctctcttatccagataagctttgaatttatgcaaatattcttcatccggaccatcaaagaaggatacaccggatgccccgttattgtacgcttcatccagcgcctcttcaaaattgtccttaatatcaccaaacatcagtccggcatatatcttggcacgcccattcaccgtttcaacgctttcctttaccgaacgcccgatccattcaggaccttcataatagaatttattataaatcatcggataataagcatccaacgtccattctccccaatcttggcgcaccatcttgcgagccatggacggccccgggaacactgcggcagaaatagctttatgatcggctttcaccgctttggtaatggcatccaccacacgagtgatggcatccagacggaaattgatccaactctggttttccatcggatactttaactccaacggatcctgtcctgttttagctttaaacaattcacggcagacatcacaataacaatagtcatattccggcaactcttctttctgctctataccatagtttttccataggctgacaggcaagattacatccggcatacggacataatccagatgaacaccatccacataaggcttatgggcttcctttacatagtcttctgccagatactctgccacaccttggtgattagggcacaagaagcgataataatccacgtaggccggtttgtcgtgacaagactcgcctttacggttcacggcataccagtcgggatgcttgtccagcagttccctgcggttcatcgtccatttccaataatgtgcctccagtccggcttctttgcaaagacgataaatattttcattgtatccctcgaacatgacacccgaaataccacattctttcaacaacgcaaaccattttttccattcggcatccgaacggttattcagacgcatccacaaccagtttttaacttcacgggcaggtatcttttctgtccggaaacgtccttcattatttatcacataacggactccttcagcaggattggttatagctatctgataggtgttctgagtcgcttccaccgcaatccgggcatcagccggaagatctttcaactctttatcagtcaaaaagaattgttctgtggcacgcaagtagttatgttgtttactataattatcctgctgtgcgtagaacatagcccatagcagtttatagatagcctgattgtacggataaaccaactcatcctgcgagattcccacttgcttgtctacgaaataaagatatccccaacggtcgggcatgtgcatatcgattcttccggtaggagtccatacccaattttcctcgggtcctttctccttcagccactgtacacgcgagaagttgatgcgccaggtgttgccggccttcaacggattgttaaagttcatggtcagcgcctgatgaggaatggccatttccacactccaatacttatctttatcttttgatttattcagtgtaccttcacaatggatggcggtcttcaatccggggcagtcccattgcaccatgaaatttccacccgaacgataaggtttgtccagcatcaggtcgaaaatcacgccacgcgcattggtttctatttcaaaataattgtgtccgtcgctatccggatcgataaatacttcaaagtcattgtcataatagatgatggtatcacgctgggtaagacgtgccttgatatcctcttcttgaagaacagctcctacatataaatattcatcatcccacagcatcttggcggtagtttcatatttgggagtcgggaatccttcgccgcttatatctacaaacggagcggtagacgccgccttcttccaggaactttcattcagtttaccatctattttcaactttccatccggacgataacatacataggtacgcggttcggccagaaaacgttcatattgttcaaaaaggctttgtgccattgccggaaaagtaaccagcagaagcaacagggtataaataagtttcttcatctatttttctgattcagattagttattatcttgcacttgtcccactccacgatagagtttgatcggtccatccagcaacacggccagcacggtaatctgctcatcctgtacctgttggggtacatcaatataaagattgcccggtactgagttccaataatttttattgtagaccttgtaattcaacatagctccgttaccaaccacccatatacggttcactttgttcatcagcccttttacttccaccggaccgttaggtttgtaaggaaggtacaaatacagaatatcccccgccttattcagtgtggtatatccctggaaatgctcggtaggaatccctgcgcgagtttcataaatagcttctttatgcttcttggtccatcggccgaactccttcaacacagcgatctgttcttcaggaatggaaccgtcctctttcggaccgatatccaataaaagattaccgcccatgctcaggcagtctacaaatgtacgaagcaagatatagggtgatttatagttgctgtctgtatgctgatatccccatgaatcattcatggtcatacaaagctcccaatatttatcctcgggacgcaccaccggcactccctgttcgggagtagcatagtcgccatatccctgtatgcgcgaattgataatcacattcttattatccgaacggagcagatctacaatacctttggaattccaagcttccgcactttgttcccagtctccgtcgaaccaatacagatccggtttccaggttttgttcagctccgccaattgtccgaaattgaacttgttgaatctggcccaacgttcaggatcatttttataacgtacttccgtacgggttttgtttgggtaatcaggatgagaccagtccaataaagaataatagaagccaagtttcaatccttgttttcttacttcctttacaaagggagctatgagatcacgttttgccggagtgcttttcacgacgctgatatctcctactttggtatcccataacgcaactccgtcatgatgtttggtagttatcactgtatatttggctccactttcttttatcagatccacccaagccttcggatcatacttggaggctgtgaaacctttttcctgctccatgtattcatcatagggcaggtagttgttaaagaaggaccagctttcggacactcctctgacggaataaattccccaatgaataaagatacccaacttggcttgtgaaaaccattccattctcttgtctttctgctcgactgtttcattctgtagcgtatcttgtgcccgtaaaggagaagctgcaatcagcagactcaggaacgctaacgataatcggttctttttcatatataataggtttgattagttaggatagcatgtcagtattattaaaatttacagctatataatggacaaagataatgtatttttatattttattctatctttgcacccctaaaacagaacaaatatgagcgcaaagaaaaagaaacaatccaatagtcccctgagagtcatcattattttagtattactgggacttttggcatataaacatcaattgtttgacgggaaactgcttgaaaatatccccactatcgaaagcaatgaagaaaagccagaaatactgacctcgccccagcatgacggtgcattggaaattccgatgatacaatcaagtacaggcggccagattctgaaacgtaaaggatataccctgtcttataatgccgattacaaaactccacaatgggtggcgtgggaacttactaaaaaagaaacaaaaggaaaagaagggcgaacaaataaattcttgcccgacccggacgtacgtggagccaaagcatatacgggagattatacaaaatcaggatatgaccggggacacatggcccctgccgccgatatgaaatggaacaaacaagccatggaagaatctttttatatgagcaacatttgtccgcaaaatccgaatctgaaccgcggcgactggaatgacctggaggaaaagtcacgccaatgggcaaaaaaatatggagccgtgtatattgcctgcggacctatatatgatactaaacgccccaaaagaattggcaacaataaagtggcagtcccccatgctttctataaagtcatattgataaatgataagaaaaatccgcaagccataggatttattttccccaacagcgccggacataagccactgaagaaatatatggtaacagtagacagcgtagagaaaagaacggatatcgatttcttccctgccctgccggatgaaatagaaaacagaatcgaagcggagttggtacaagaattaccgtagtctatcacacatacgcagacatgaaacgatacatacgtatgtatacccccacacatacgtatgtgtgggggcacacgaacgtacgggttttatttcacttccagcactacgatagacttggcaggaagagtcactttcaagcttcctttattgacctttgctccggtaaattctttcggggcaaccacattcggtttctcgaaactattgtaatcacctatattgttagcagtcagaatacggccggtaacactcttggcctttacctcacccaagttcaactctatttcctgcgattcctgcaaatccacattagacaaggaaatatgaatcaaaccgtttgcatcccgtgaagctgtagcacttaccatcgggacaatacggtcgtcgcgtacaatcttgcgttcacagttcagttccaaaggaagataagtagcatcctgatgcactttatacatttcaaagacatggtaagtcggtgtcagaaccatcttgtcgtcctttgtcaaaatcatagactgaagcacattggcaatctgggcaatgtttgtcatcttgatgcgatccgtatatttatggaaaacatccagtgtcaaagaggccacgaaagcatcgcgcaacgtgttctgctgatacagatgtccacggacagttcccggctcttcatcccaccaggttccccactcgtccaccatcaaaccgatttgcttcttcggatcatatttatccataattgccatatgcttcttcagcaccggttctatttccagacatttgcccatagtccaataataatcatcatcagtgaactgtgtagccgatcctttgcttccactccatcccatcactgtataataatgtaaagacacaccggccatacggtgacctacattcttcatcagtacttctgtccagttatagtcataatcactggcaccacttgcaatcttgaacaagtgattgccatcatagtcacgacaataagtggaataacggcggtacaagtctgcataatattcaggacgcatactgcctccgcatccccaactttcattacctaccccaaagaatttcactttccatggtttttcacgaccgttctccttacgcagtttcgccatcgggctaccttgttcggaagtcatgtattccacccatttcgccatttcttccacactcccacttcctacattaccgctgatataaggctcacaacctatcagctcacacaagttcagaaattcatgtgttccgaaactattatcttccactgtacctccccaattgttattgaccattcgggggcggttctctttcggaccgataccatccatccaatgatattcatcggcaaaacatccgcccggccaacgaagcaccggcactttcaaatctttcaatgcctgaagcacatcattacgatagccttgggtattgggaattttagaatcctcacctacccacaagcctccatagatacaggtgcccaaatgctctgcaaattgcccgtaaatatgtttactgatgatttctttcccttgctcgggatgtacattgatagtcgctttctgttgggcaaataccggcattgcagcgaacaatgccaagcccataagtgcatttttcatgattaaaaataaaataattaattatactatatttgcgttctcgtttttcgtttggtcaaatttacacattttacatcaaccggatagtggacaaaattgtatttttaggggtacaaaatcgtcaaaagtagaaaagaaacggatatttgcctatatttgcatacaaaaaagcccgatagactaaaatgaataaaaagaagcgtactattgtatggattgttatccttatcattatcctgacaggagcaggcggtgcaggaagtatatattactatttctttgccaaacaattccaacttacaaaaaccacctatatttatatagacagagatgataacctggattctgtataccataaaataatccggaacggacatcctaaaagtatgttcggttttcaatatctggcagaaaaagagaagtatggcgacaatatacggacaggacgttacgctctcaatccatcggacaatatgcgctacctcttccggcgtctttccatgggataccagactcccattaatctgactgtacccagtgtacgcaccgtggacagattagtgcgggccgtttcgcgccagctcatgattgattctctggatattgccaaattaatttccgacagtgcttactgtgcacaaatgggatatacccaagagacactaccctccctttttattcctaatacttacgaggtttattggaatatgagtgctgacgctttcatgaaacggatgcaaaaagaacatgctgccttttggaataatgacaggctgaaaaaggctcaacatatcggacttactcctgaagaagtgtccaccctggcctctatcgtggaagaagaaacggccaatggtcccgaaaagcccatggtcgcaggactttatattaacagattgaataaagggatgttgttgcaagcagacccgacggtaaaatttggtttacaggaattcggactgaaacgcattcttttcaaacatctggaagtggattctccttataatacctacaaacatgcaggtttacctccgggacctatccgaatcccatccatccaaggattggaaagcgtactgaactatacacagcatcattatatttatatgtgtgcaaaagaagatttctcaggcactcataatttcgcggtcacagcagcccagcatcaagctaatgcaagacgctatcaacaagcgttaaaccggcgaaaaataaaataaaaggagcggactataggtccgccctcccaatggattatttaatgtgtatctatagaatctttcagcaaccttcctttgtattgtccttttttcccggtcatctttccatattccactgcatgtaccggacaaacatggtaacaagccagacattgagtacagttacctccccaaacgggacgatccgtcactgttatattgcccacaggacaaaccttctcacacttcttacaaccaatgcaagcttccgttgcatgaaaaggcttgggagacatcagaaaagcattgaaaagagggcgcagcaaataggatttagtaaatggaagcgcaccttcatgacaattatattgtttcatttgagcccttgatgtaatttcttcgttgataaaacgcacacaggcaacagcattctgtactttctgggtttctatatctttatcatctacatcaaaaccgggcaaagaaacatacgtattcggcatagtaaccgaatagccggcaacacattgccaacctttccgggtaacggcagaagaaaaaatttgtgcagtccggcctgtatcatctccgcaagtacagacaaagaaaaggtatcccggcttatccaactttagctgatgaataaaacgaagtactatcttgggagggccccatgcatatacaggaaaaacaaaacctactttttccccttctttcagcttatacgctttgttcctgtctatttccatagctatggacaacaattcctcattctgtccttccgccagctgccttgccacccaagccgaattacctgtacctgaaaaataaaatatcatatccgtactatttttataaaaagaagcgatgctaatcttttgaattagcatcgccttataatgaagccgcaccagtgatgcgatgaaactccgaatgacaggttttgagtgctctcctcctttgtaatccaccggcataaatgctacccgaaggcgtggcccgccattggaagatgaagctatgtctcggttttcagattagtttgatgagtttcccaatccaactaatgcggctcgcttttcatctctttccgtatgacaaatatacgtcctttttatgatataaacaagagtatagcagaatttgtttgttaaaaataataagcaagaaaataactctctgtaattctgcttattgttgtttccatttattaaggaaacatcacaaggcatccgcaataaaaaagagcaacctcgtagagattgctctttcataaatctttatatcgccgtttacagaagaattaagcagcttttgctttagcaacaattgctttgaatgcttccggatggttcatagctaaatcagctaacaccttacggttgatttcgatacctgctttgtgcaatgcacccatcaatttagaataagacattccttctagacgagcggcagcgttgatacgctgaatccacaaagcgcggaaattacgtttcttgttcttacggtcacggtatgcgtaggtcaaacctttttcccaagtgttttttgctactgtccatacattctttcttgcaccaaagtaacctttggtaagacctaaaattttctttcttcttgctctagaagcaacatgatttactgatcttggcatagttttaattctttttgaatgttagcgccactgtttcacacggtgaacttaaagctaaagacattcggttaatactttaaataatacgtttacgctttcgttgtttttagattacttcatgcaaagcaattccttaacctgatccaagttagcattagctactagacctgagtgtacaaggtttcttttctgctttttagtcttcttagtcaaaatatgactgtgaaaagcgtgctttcttttgattttacctgttccggtaagaacgaatctttttttagaaccggagttagtcttgatctttggcatcttgtttttaattttaaattattattcaaatggtggtaacgcactataccggcgcgttaggcactcttttttcattcttttgtttctactgcctttttcggattttcctttttagcagtatccgtttctgccttcttcggagagcccgctttcttcggagccaaagaaatagtcattctcttaccttccaacaagggcatctgctctacttttgcatattcttccaagtcattcgcaaaacgaagcaacaatacttcgccttgttctttgaaaagaatggaacgacctttaaagaacacatatgctttcaccttgtctccgtcctgcaagaatccgatggcatgtttcaacttgaagttgtagtcatgatcatctgtttgaggtccgaaacggatttcctttacgtttacctttacctgtttagccttttgttccttttgacgtttctttaattgataaagaaatttagaataatcaataattctacaaactggaggaacagcattgggtgaaatttcaactaggtcagcctcatgatcctcagccatttttaaagcttgagctatcggataaactgccgattctacatcgtcgcccacaatgcggacttctttggcacgaatctgttcattgattctgtgttgcccttttaaactgtcattcttcattaaaaaacttttagttcctgtttgtttcttcttattttaattagtatttctttatcttaacgcaaaagaatacataaaggtttaacaatgcgctcttttgcaaacggctgcaaagttaccatttatttatcatattagaaacttcttcggcaagattttttccgaattcttctattttcatggttcctttgtcgccttcgccctgcttgcggactgcaacttcaccgttttcagcttctttctcgcctacaatcaacatgtaaggaatacgcttcatttcattgtcacgaatcttacggccgattttttcattacggtcatccacaatagcacgaacatcgaattttctcagttccgctttcacttgttccgcatactcattgaatttctcagaaataggcagaatagctacctggtcaggagtcagccacagcgggaatttaccggcagtatgctcaatcaatacggcaacaaaacgttccattgatccgaaaggcgcacggtgaatcattaccggacgatgcttttggttatctgagcccatatattccaactggaagcgttcgggcaagttgtagtctacctgaattgttcccaattgccagcgacgaccgatagcgtctttcaccataaagtccaatttaggaccatagaatgcagcctcaccatattccactttcgcagtcaggcctttttcttcgcaagcttcaataatggcctgttcggctttttcccaattctcatcgctaccgatgtacttttcgcggttcaccttgtcacgaagagaaatctgagcttccacattctcaaaattcatagacttgaacacaatgttgatgatatccatcacgcgaaggaattcttccttcacttggtcgggacgacagaacaagtgagcatcatcttgtgtaaaactgcgcacacgggtcagtccgtgcaattcaccgctctgttcgtagcggcatacggttccgaattccgcgatacgcaacggcaggtccttataagaacgtggagagttcttataaatcatacagtgatgaggacagttcatcggtttcaggaaatattcttccccttcttcgggtgtatgaataggctggaacgagtccttaccgtacttggcgtagtgtccggaagtgatatacaggttcttgttgccaataggcggacacattacttcctgataatcataacgggcctggatacggcgcaagaaatcctgcaaacggatacgcaaggcagtacctttcggcaaccacatgggaagtcccttgcccaccatatcggtaaacatgaacaaatccatttccttacctatcttacgatggtcgcgtttcttggcttcttccagcattaccagatattcgtccagcattttcttcttcgggaaagttataccataaatacgtgtcatctgcttgcggtcttcctgtcctctccaataagcaccggctacagaaagcagcttgatagctttgataggagcggtagaggtcaagtgaggaccacggcaaaggtcggtaaacgcaccttgtgtataagtggtgatgtgtccatcctccagttcggaaatcaattcacatttataagtctcacctctttcaccgaatttcttcaacgcatcctctttagcgatgctctgacgcaccaatatctctttctttgcagccaactcggccatcttggcctcgatagcgggtagatctgcttccttaatgattgcttcacccggatctacatcatagtaaaaaccgttttcaatggccggaccgataccaaactgaatgcccggataaagttcttgcaatgcttcggccagcaagtgggcactagtgtgccagaaagcatgtttgccctgttcgtcttcccatttataaagaacgaagtttgcatcttcattgatagggcgagataaatcaatcgtttcaccgttcacgccacaagctaaaacatcttgtgccagccgtgaactgatactttctgcaatctgcagaccagtaactccttcgttatattcgcgaacggagccgtcggggaatgttatctttatcataatcttctatttatattctttcttgaggatgcaaaaataacgaaatctttttgacttatcctctttttagcaaaaaaatgttattcttttcgttccgtaaagcgtttgatgatattgtaagcagagaaaagccccaactcacctgctttactcaggtcctgtataccttgcctgttgttacccaagaaaatatgtgtcaagccgcgattgaaataagcatccgcaaatttagggtccaactggatggctctgtcataatcaacaattgccgcacgatagtctttcaagatagaaagcacattacctctattataataagcatagacaaaatccggagccagctcaatcaccttgtccaaatcgcgctttaccatttcatagtccgcagctttcactgcactcttctctcccggaccggctttcaaatcatactctttttccatcttctggtattccagctgcttataacggatgagagcacggttgaaataaaccgggaagaaatgatcttctataataatagcctgattcaagtcttcaatggcacttgcaaaatcctgcaccagataaaagtccaatgaacgtgcaaaacgtttgttcacattattcggatcagccacaatggcagcagtctgttcgtcaatggatgcaaaatgttttgtagcttgttcttccgtcagaggagcttcctcattagttataatcagacggctgggaagtactttctgattattcaatgtttcaatgaacttataatagttgacctgtcgcttcacgtcatcatgcttttcataataggtaagcacgaacatgggctggggaacaatattcacattcttatcctgcacgcgtccacgatagtcactcttatatttttcttctccctcttcgttgtcggcaaccactatcttacgatagttgttcatgttcttatcggacttcttacgggttttattattctccgtattatcggcagtctgcttattaggatctactccgttctgtttatccagctgtgctttcaacaccttgaattcatctgcatcagcacctttcacatcccctattttcctacgcgcctgcgctctgtactgatatcccagcaagaaattgggatattcatttatcaccgtagaataatctttaattgcccctttataatctcctgtctgatccaacaacagaccacggttgaaaatagccatcatattgtcgggctccatttcgataacaaaattaaagtcttgaatagcccggttgtcatcgcctacttgtgcacgtaacaagccccggttataatggccgatgaaattattggggtcaatatccaatgcaatatcatagtcactcatcgctcctctcaggttattctgatggtaacgggccaaagcacggttgatataaacacctgaattccgggtggacagacggatggcatgatcaaaatcggcttccgcatctttatatctctgctgttgcagacgaaggatagcacggctggcccatgtatctgcatcataacggtctatttcaatcgccttgccaaagtctttttcggcagccaaagtatctttctgcttcaaatccacctcaccacgcatcaaataggcctttgtatatcggggggaaatggcgatcagcttatccagatcattcttcgcccccttataatcctcctgtctgatacggcaaagggccatattatgccatacccctatgttctcaggagcaaactccaacgccttggtataatcttctatagctcccgcaaaattattctgctggatccgtgccaatccacgcacctgataagcacttaccacaaacggattcctctcaatagcttccgaacaatcactctccgccccctgaaaatcatccaaatttatcttcgccagacctctatagaaataaggatcagacaaataaggctttgcattaatcacctgattgaaatattgaatcgaaaggacataatcctcaaaataaagcgcattacgccctatcgccatcaccctgtccgtatttatctgtgccgaagccactacagggaacattattaataatgtatagagtatccgttttatcattttgtatttataaaaatacggttttcccacaaatgcgccactggtggcgcatagatcaaaattgcggagttatcattttatagtcttgaccttataggagcaacgcgccttgcccttcagcatggcccccagctttcctttaatcatctgtttgcgtaatgcagacaaatgatcaatgaacatttttccgtccagatgatcaaattcatgctgcatgacccttgccaaatagccttccacccactcgtcatgttctttcagctcctcatccaaataagtcacatgaatacggtccggacgtttcaccgtttcatggataccgggcaaactcaaacaaccttcttccatgctgacttcctctccacccacttctaaaatatgaggatttatataggcacggcggaaatccttgaattcgggcaagtcatcagacatcacatccaaatcaatagttacaacacgaataggcagacctatttgcggagcagccaagcccacaccatctgcacgattcatggtttcaaacatatttgctatcaactctttcaaattagggtaatccggggtaatatcctctgcttctttacgcaacaccggttgtccgtacacataaataggtaatatcatttttcttaatctgtttttatttattaaatatatttcttcgactccaaataagactgtaagattatcgtagcactgatttcatcaaccaaggctttgttctgcctgtcttttttcttcaagcctccatccaacatggcttggtgggccaatacggacgtaaaccgctcgtcaacaaactctaccggtatatccggtattttttttcttagttgattgacaaaagggacaatattacgcatattttccgactcctgattattcatttgcttaggatgccccacaatgatgcgttccacaggctctttttccacatatttcagaataaagtccagtagttggtgtgtaggaacagttgtcaacccgtttgcaataatctgcaaaacatccgtcacagccacacctgtgcgctttttaccgtaatctatcgctaatattctactcatatagtttgcaaaaatacaaatttattccatacctattttatatataaagattaaaatatgctttttcaactgttttttctaaagaaacgattcatttcgtttaattttatttgctatttaaaaaatagtacttatttttgcaccgaatatgtggcttagcgtaagggtcgcataatgttaaattgaaacaagtatttgttataaaatgaaaaataagagctcttccaaaggagtttcatatagatgtttgttgtattgtatagctatattgttgcttgttatgattccattaaaaagtttcagccaatcaacaggagaattaacaacagacagtcttgtaaaaatgggatttgaaaatgtaagatggacagatactcctgaagaaagagtttatgtggttgaaaacagtgcttacaaaattcaagcgttgggcatcagaaaggctgtagatatcatacagtcgatgggattacccaaggacaaatcttgtaagttgattgttaccaactataatatacctcaggtctcacttacctatcagcctcttgccggtgacacaacagtggtaaacggtgaagactggaaagtcagttatgatataggtgacagttggaacaaggtgaagaaagaaaagaaaaagaacagttcgctgtttaaagtagatatattggtatatccgcagctatactttaagaactatatcattacacagatatatcaggctttattagagtttagcccggcggtagaggtgtcgctttggccaggaatgaaatttaccggacagattgtatttcctgtatacaatgatggatatggagaaacagccggaaaaattcatccaggatatttgacattagcacaaaaatttagattaccatataatatacaaagtacagtaactattggtatgtttgattataatacatatggtgcagatttaaatttgttttatccgtttaaagacgaacgtttttctttagaaggaagaattggctatgtcggatttggatattggcatggttttaaatttcgctataatgataaatacactacttattggtctgtagggggaaacttttactggccaaggtataatacacagtttaaattgagagctgaacaatatttattaaaagaaaaaggggtaagatttgaaatgatcagacacttccgctatgccagtataggtttctacgctgtaaaagcagaacatgccaatagtaatggagggtttaagttcatcgtcgcattaccaccttataaatataaaagacataaatatataccaagggtttctacctcattgggtacgggtataacatataatgcaggaaatgaaaaatattattataaaatgccatatagtaatgcaagtgacaatataatgcaacaaaatagttttaatccatattttattaaatcagaattattaaatttttaattttattgagatgaaaaagaaaagttttttgagcggtattggtgctaaattagcattagctgcagtagctttaacaacagtagtgtttacaagctgcgaaaaagaagaatttaatgtagaaccggtagaactatcacctgctagtgcgacgattgttgccaccgtatatgatttgacaacgggtgaagttcttgctccccaagcaattgttgaaacaatcactgcaggtacagatggaacaattgcagctactacaaaagaaattagttgcccctctttcagcaatgcagaatatctgccagtagaagccattactgtggcaattcctaaactagcaaaaggacagtttgctcttattccggtaaatttctatgctcagaaaatagtttctgctgctaaaaatgtaacagtaagcgaagacccaactacaattgaaacaactgaagttaagaatactcctgttacttacggaccttatgatgtagacaaaaatatagatattgaatatgcagctaaagtaggttcagaagttgttaatattaatgctattaacagttacattgaaactcttgttaactcaagagcaatgagtaacgaaaatgttatcaaggttttaaaagcagtagtcggtacttacaatacaggtattaaaactgaaatgcagaaagaaacaagaactatcaaagctcaaactactgtaacattcagccctgtaacaacaattattgaatcagtcgttactgtaactgcaacagttgatggagtagaatatactattcctaatgtacagcttagaaaagctggtgcaacagttgtttctgaatcttcagaatcacacgcaggtcacgatcacggtcatggagataacagcaactcaggtggtggtgcaggtggaagataataattaatcatctatcggttatttgttcagttattcaccaaaaaatataataaaaatgaaatataaattcttaacactgtcacttttgttggcaggagcttgtgcaactacggttatggcacaagatactaattattatactccgaaatggagtgataacatctttgtcagtgtaggtggaggtatccacgctattgaaaacgatggtttcaataaactggctcctcacttcagtatctctttgggtaagttaattactcccacatggggaatacgtggtcaagtaaatggtatcacacaacacttgtgcttggataacagttactaccaacacaacaagaattatgtaggagctaatatcgacgctatggtaaacttgtcaactctgtttgcaggtgctaatcctagccgtttctttgaagtttacggttttgccggtcctatgctttctgtagctaaatcacagaatgtaacaatcaaaaatgatggaacaatggttcccgaaggtgaaaataaagtaagagcacgtatcggtgcatctgccggtgtaggcttgaaattcaacattaacaaatattgggctattgatgttgaagctcgcggcgctattgctccctctatctttggtaatatcagcagccaccgtaaagctgaaggaacaggtatgttgacagctggtgtcagctacatcttcggtggcaagaagtttgctaaagttgaagaccgtgtagtagaaaaagaagtgatcaaggaagtggttcgtgaagttccgaaagaagtagtcaaggaagtgattaaagaagttcctagcgctgcagaagttgctatcttcttcaagatcggtaaagcaaagatcagtccggaaggcatggttaatgtacagttaatggctaaagctatcaaagctaatcctaacgctaagtacaaaatcgcaggtttcgctgataaagctacaggatctgcttcattcaaccagactttgtctgaaaaacgtgctcaggctgtttacgatgcattggttgcagaaggcgtaaaagaaagccaacttgaaaaagttgctatgggtggaacagacaacatgtttggcaagaactatctgaaccgcgtagttattctggaagtaaaataatcattgctacctgataaaactctgataaattaaagaagggggtatcgtaacaaacgatgctccctctttttttcttcaactgcattttaatcacataagcagcaacagcaaacaaaccgtataacaagaatctacgaatcttggctatacaattccggaaaccagaggcagcatttaccgaatcttgtaacaagataccgggctatatcacaaacaaaaagcttttttaaaatactcccaggatatataaacaaagggcatataatgttgcaggtgcaagatatatatcttgcacctgcaacattacacaaacaaaagcatttacttatcttcaatagaccagcttcacattgtcaacccaaagcgtatttccgggagagccgataaaagctcccccatgactggacgaaaattgcagtatcatgtgggtaggattctcattggcctccgcccatcctgtttctttaatcaagacactttctcccttactatttctagtataatctcgctctctcaaccccatcgtttcatgatcataagacggatgcttggttatatcaccatacagcacttcataagtagcaccattcacccaaccatccgagtccttatcatacttcaccaccatagttcctaccctcttcgcagtaatatttccttcagcgtcctccatacgtttttgcaaaaagaaaacagttatcgcacaatcctgccctgccacctgacctttcttgctgaagcctgtcaaccggatacgatctttctcaccagacatctttaccttataatcataacggacagctttgggacgttgggtaaaaggaactccccaattcatattcttctcagcattcttggttcctgttatcggctccaacatatcacccaaataaatggatccggctgccaatacagtaatattcaccattcccaataccttgacgctctctatatgcgtttccagacgagcacaatatccattgtcccgtttgtccctgtaaacagaattatttgttttaacaatgcccactaccttagccatcacattagaggttccccaaggagaccctcccatattcttataaggtttgttaccatctatttcctttgtagggcctatctcataaagaagtttggtattgccgcctataacaccggactcatgaaccttacggattatccactgatccatatctccgtattttataggtaccaccttttcctgggcaaagccatacagcggtgctatagccaaaagagcagcgaccgataatctgccataatatttcatacccttagtttttattgttgtttagaaccggcaaagctataaaaaaaagcggcaacttcacagttgccgcttttaataaagaaaaatagactatattttcttcttaatttaccaaaaagaaatcattaatatactctatatagtaaccatgccttttggaaatcgtcacggttaggatattttgccttaaattcctcctttgcctgagtagcctccgcacggtcatcgtatgaagatgctataacgcgatacgtatttctttcagcattataaaccactttggcattatagccttggccatccaaatattgtttcagaccttccgcattcgctttcacgccaaagctaccacatactacgctatatgcttttaagccgtcacctgaaaccagttctactttctcttcgcgaaccggaccggcaacaggagcagttgtcacgggggcagatactaccggagcagcttcaaccggagtcgcttctacctgatcggcaggagcttcagccaattcctgttgttttgccttttcataagccttcttgtaagcactttcgctagatttacatgaggaaaatgccaaggctacgcacaatcccatacccaacacaactaattttttcatgattactcaatcttttataaattaatactctagtttaattccattatattggtgcaaaagtagcaatatatcaacagctttcacagcaagaacggagttaaatttagttaatcagagaagaatctccaatttctattcaaaaatagacaaaataaacaacaacattcagttttatttgttagatttgtaaggtacaaaaaacaaaaaactatgaaaggattaagtattttagctgcattcctaggcggagccgtagttggtgcagcagccggtattttatttgctcctgaaagcggagaagacactcgtagcaaaattgctgatgctttacgtaaaagaggtatcaaattaagtcgcacagatatggaaaatctggtcgatgaaattgcagccgaggtaaaagaataagcaacgcccacaaaagtgtattgtcattccggatacaagtccggaatgacaataatttttaaatcaaaactccacgcatgtttgcaaacgataaaaatatagataatctgcaacaacttctggcagagcttaaaaagtacgcagagttacaaaaggattatgtaaaactacatttagtagaaaaacttactatactgatatcaaccctcatccttgtctttatattattgatattaggtattatcgcccttttctacttatcatttacattggcctatgtactcgcacctcatgtaggcgggcttatggccagttatggaatcattaccggatgcattattctgctgattctgttaatcgttttattccgcaaacggctgattgttcagcctatggtaaatttccttgccaacttgcttttaaatgacaactgattatgaaagagaatactcctaataaaacgcccatcatcactttggaagtgatagcacaacgaaaagctgagaagttggaagaagtacagcaagctaaaaaagaaatggtacaaaccatacatgaactttttgcgcctgtagaacacaaaggaggcgtagaaggcattatgcaacatatcaatacaggaatcgccgtttatgacggagtacggaccggtatcaagatcatgcaaagaatcagaggatatttcctgaaaaaaaagaaataacttagtattaaccacaacattttatccacatgaaaagacagctactaggtgtggcggcaattttgttgtcaatttccacgtatgcacaggacaatccattatggatgcgttattgtgccatttctccggatggaaccaccatcgcattcacctataaaggtgacatctacacagtaccctctacaggcggcagggccagtcagattacaaccaaccctgcccacgacaccaaacccatctggagccctgacggaaaaaaaattgctttcgcatcagaccgaatgggaagtatggatatttttgaggtaaacaaggaagggggtatccccaaaagattaactacccattcgggtaatgaaacaccggtggcttataaagatgccggacacattctgtttctagccaatataatgccaacagcagaagacgcacaattcccctccggacaattccaacaagtatatgaagtcaataccgaaggcggacgccccatcctcttctcttccatgccgatggaagatatcagtatcaatcatacaggcaatactttactctaccatgacaaaaaaggatatgaagacccttggcgtaaacatcacacttcatccattacccgcgatatttggctgtgttctctgaatggaaaccgtacctttcgcaaacaaactgctttcaatggtgaggaccgcactcccgtttgggcttcagatgataaatcattctattatttaagtgaggaaaaaggctcatttaatattttcaaacgtgatattgacggtaatacatccaaacaaattaccaaccataccaaacatccggtacgcttcctgagtgccgcctccaatggaacattatgctatggatatgatggcgaaatctacacggtaaaagaaggtgccattccgcaaaaagttcagatttccattgtcaccgacaagaacgacaaagatctcatccgccagatcaagcgtagcggagcaacagagatatccctttcgtccgatgcaaaggaaattgcttttgtactacgcggagatgtatatgtcacatcaacagaatacagcactactaaacaaatcaccaatactccgcaacaggaacgcgatattcacttttctccggacggaagaagtattgtttacgctgccgaaagaaacggattatggcagatttatcaaaccagtctagctaaaaaggaagaaaaacagttcgcttacgcaaccgatatcaaagaggaaagactgaccaattcggatatcacttcattccaacctcaatacagtcctgacggtaaagaagtagcctttcttgaaaaccgtactaccatccgtgttctgaatctgaaatcaaaagctgtacgcaccgtcatggacggcaagtacgaatattcttatagtgacggcgaccaatggtatcaatggagtccggacagcaaatggattcttaccaactacataggtattggcggatggaataacaaggatgttgcactggtcaacgcatctggtaacggagaaattcataatcttaccgaaagtggatacagtgacggcaatgccaaatgggtattggatggaaaagccatgatttgggaaagtgaccgcgcaggattccgcagtcacggaagctggggtgctgaagcggatatctatatcatgttcttcgacctggacgcatacgaccgtttcagaatgagcaaggaagagcttgccttactggaagactcggaaaagaaagacaaagagaagagtgaagagaaggagaaggccgatcataaaaaagataaaaagaaagactccaagaaagaagatgacaagaaggaagtaaagccactggttttcgaccttgaaaacagccgtgaccgtgtgattcgtctgactgtaaattcttcacgattgggagatgctgtattaactccgaagggtgacaaactatattatcaagcagccttcgaaagcggatatgatttatgggaacacgatcttaaagaaaacaagactaaaatcgtcatgaaaaaagtcggtggcggagccctgcttcctgataagaaaggcgagaatctgttcctttgcagccaaggtggtatcaagaaagtcactgtcagcagtggtgaaaccaaacctgtagaattcgaagctttcttcgactaccaaccctatggtgaacgcgaatatattttcgatcatgtatggcaacaagtagaagataaattctatgtaaaagatctgcacggagtagactggaaaggctatcacgaagcatacgcacgctttcttccatacatcaataacaattatgattttcaggaaatgctgagtgaaatgctgggtgagttaaacggttcgcacaccggagcacgttactactcaaacggtcctatactatccacagcgaccctaggagtattctatgacgaaacttatgatggtgacgggttaaaaattaaagaaatattggcaaaaggcccatttgccgtgaaaaaaacggatgttactcccggttgcatcatcgagaaaattgacggcaaacctatcgtgaaagggcaagactacttcccgctgctggaaggcaaagccggaagaaaagtgttactggccatatataatccggctaccggcaaacgttttgatatcaccatcaaagctatcagcatgggcgaacaaagtaacttgctgtacaaacgttgggtagaacgttgccgcaatatagtcgataagttatccgaaggccgcatcggctatgtacacgtaaaaggcatggacagtcaaagtttccgcgaagtatatagtgaagtattgggacgctgccgcaacaaagaagctattattgtagacacacgccacaatggaggcggatggctacatgatgacttggccactttattaagcggcaaggaatatcagcgtttcgttccacgcggacaatacataggcagcgacccattcaataaatggctcaagccatcctgcgtattggtatgcgaggacaattacagtaacgcacatggcttcccatgggtttacaaggaattaaagataggcaaactgattggtgctccggttccgggcacaatgactgccgtatggtgggaaaaccagatcgacccgagtattgtgttcggtattcctcaggtgggttgtatggatatgcgtggacaatatgcggaaaatcaccaactttctccagacattgaagtttataatactccagaaaaggcattggcaggtgaagaccagcagttggaagcagccgtacaagaaatgctgaaaacaataggggaaaagaaataaaacaatcccatcctgataaaaagaaaaaggtgtcaaaacacaacctttgaggaaaaggacttttcatccgaggatactttgacaccctttatcagccataaaaagagccgtatcaactctactcccaagtaatgatacggctcttttttatacattacagcaagataatgtatggggcatctatgctgagcatacttaaatatgtcataatgatgctctataagttgttcccactcatgccctcatttccaactataacccactcattgtaaagtcattaccctcactccttattcctcattctcatctcttaagacactcattcacaatataatatacattcacaagcctataaaccggttatttggtaagccccctgttttttcagtttttcttccttgcacaaacggcataaataacggtgtcgtagtttgtatcatactgttcttctttgacgattaaaagttcaatatctgttaatcacgaatgtaattaagtctaatcactattgtagttaactttaaccactactgtaattaaacttagtcacagtagtgaataagcaattacaaacatataaaagtgagaaaataaaagggagaaaacagataagagacagggaaatatgcatacatagactaccgccaactcgctgcacaagccatgcagctgctttataagaacgaacgttatgggttgaatgatgaaaatgagaaggtattttggcaaaacaacaccgaatttgagtaaatttcgcctttggaacagttgtttaaatgtcacttctattccgccactacagagaagaagggagaaaggctgaccgcacatgaagattttcaattatttgcaagagtacaagcgtgaaaaacctgtcaatcaacaagataaattaatacagacacattatccgcaaactgaacattcacccaaaagccagcagaaaaggtactttatatcacatgataaagttagaataatttattttcaagcatctgtgttagtgagggcaatgccctcactaacacagatactaccatcactaataagcagttcattataaaccagttagagccaaagtgagggcatgagggcattttcgcgtccaactttctatttgttaagttgaaagggatggcttctattctccggtatgaaagacaccatttccggcatcgcaccaacttatcttgctctttctttccaaagacgagtcatatcttccaaagtctttccttttgtttcaggaaccatcttccacacaaacagagctgcaagcacacaaatcacgccataaagcccataggcaaataccggactgaattcatacatggcaggaaaagtggaagaaaccagataattgaatatccactggaaagctacagcgatagccactgccttgccgcggatagtattcggaaatatctctgcaatcaacacccagcagataggtccccatgacatcataaagaatgcagcataaactatgatggaaagaacaggaagaatacctcccacctgaaactcatcacaaaacgcaacacagaatgcacctacagccatgccaatagaaccaacaatcaacaagggtttacgtcccatcttctctacggtaaagatggcaatcaatgtaaagagaatattaaccacccccattaccacagtctgcatcataccatcgccaccgccaccgattttttcaaaaatacgcggtgcataataaagcacagcattaatgccgatagcttgctgaaatacagaaagcaagatgccgactacaataactgtcagcccgtatgtaagcagtttttccgttttctcggaagtcacagcctttatttcagacaaaatagttttagccttatctgttccatttactttttcaagtacagaaaacgctttatcatcctgatgggtcatagccaaatagcgcggagtttcaggaaccaaaaacaataaaatgccaaataatgcagccggaaccgcttctgaaccaaacatatatctccaaccatcggaaacaagcacttcatccggcataccatctttaatcatataattgacaaaatagactaccaacatgccaaaaataatagcaaactgattacaggaaaccaatttaccacgaatttcggaaggggcaatttcggcaatgtacatcggacaaacagcagaggcaagtcctacaccgattcccccgatgatacgataaaagttaaaagcaaggatcaatgcaaacgaagtatctcctttagagaaaaataaaaattcgggataataagagcctaaagcagacaggaagaacaataaagcagccagacgcaacgaattacgacgtcctagccccgaagcaaaataaccggaaaaagcactgccaatgacgcaacctatcaatgcactggaagcagtcacgccatgccagaaagcatctaatcccaaatgtttttgcagagcctgctccgcccccgaaataacagctgtatcataaccgaaaagtaaaccgccgagaatggctataaacaccactcccatcagatagaaattgtttttcttgtttttcataataaaagaattataatagttttcgtaataaatacaataacaaagctgtgcgaaaataatcattaatacgtaattctattataattctccaaccattttaaatctttttcacatcaaggaaaaacaagattattccgtctgaactgttctatgtcttccttttttaatcctatcttatccaatgacttaggaagattatggtcattaagataataacgcggacgaatgagatattgtctgtttgctaccgataggctatctgccctataaggtgtctgtacccctgccaaattcagcatggtatgaaacacggaggcatttcccgccaccggtttttcacggttctgcaatatagcttcatgtacttccacattcttttctctatatgttttggacaaccaaattaaaaatggtacatgcagttgataataagacgggaccggggatgcgtgtaaaaataattttcgattatcatcaaaaatatcctctccatgatccgaagtataaagcatagccgaaaaagagtttgttttctgcaataaagtgatcaaagaagccaggaaaccatctgtataacggatggtattatcatatgcattcatcaaatactctttattctcatatttggcgtctgtcagattatccggtttaaagacagacatggattcgggataacgttctttataattaaaatgtgatccataggcatgcagcacgatgaataatttttgatgacctgcctttagctccttttctaccagaaacaatagttcgtcatccgaaatattggctcctttcggagcatctttcttgataaacttccaatcatctgcctccatccccaaaaaatcaataaaagaatggttaggaagctggttcgaaaaaaaggcagtatgaaatcctgcttccttgaaagcggtaatgattcctttctgtctataaagacagtcataatcctcagccgaagctgccgaaagcaacataggcacacttttatgagtagtattagactgggtaagcacatccgtgaaagttaccaccccctccattttatcaagtaatggagtagtattcctttcataaccataaagtccgaaattacaggcacgggccgtttcccctatcaccaagacataaacttcccggctgttttcatcatgtgcggcactggcattaaaagtaaaatcccttgaagtttccgcatatccggctgtttcgcccgcacgttctgcagccaatactagattataacatacattagccggatacatttcgatctttacttgataatcacgttgcgtcgcatagcagataacggtcaataacgctcctgcaacaatgcctgccaaggcatacttacgttgagaacgaataaaagaatattccaactgattaccccgggcccatgaaaaacctcccaagaccaaagcaggaatgtaaacaacaaaaacaccaattacagccggcagtaaattatccaacagttccagcgcctccccggaattagtagttgtcagattcaggaacatatctactgcaatgatagaacgcccgaacaggtatagcaataccagttggaatgccgcaaagaaaacaaacggaaataagatccaaatagtctttccaggtttacgccccaatgtcataatcaaccaataaaccgataccggcagaatgacattacaaatacgtgcccaaagtgtcatttgctgttctgtaaaaaacaatgccacattgggaatggccaagacaacgatgaacagaacgaacaaccgttgtggctcacaacaccactgaataaattctttaaaatgcttcatttatattaaagataaaaccagactgtccattttttccaaatccatagtccagacgaacatttacattctttttaaactcccaacgataacctattccataattaggcaacactctgtccatgcacaaagcactgaacttattgaatacagttccggcccctatccaaactacaacaccattacgtttccatacatgctgacgcaattccacctgcccctctattttatgcttgtcacgatagcgcccttcgtaataaccacgcatggaatacgagtttcccaacaacgccatcatggcccatgacggattaccgaaattaaaagtaccgcgtaattctcctgccaacaatcctcctttccatacaggatgataataactggtacgcaaatccgtagtactgaatgcataatcgtttcctaaaaacttaggacggaaacactgggtaatattcaaataatatcccttatggggattggtcaacacatcgcgcgaatcatatgccaaagaaaggcccactccataattagcagtagtaagattcatcccctccagtagttcggggcgttccatattcttaccatgcacataatcataagatgccataggacctatatatagattatccgctatccgaaacaggaaactagctttaacttgtgcttgccagcgatctaaatcagattcattggcatctaccttacccatatcgtaccctattccccaaaacttggaaggaaaggaataaaaataaagagtataatccagccggtatttgtcctgcggaaagatatgagttccgcgtatccccaacatatagaagccaacagtggaaacatctccgaataaagacacattggacggaggaagaagcatgtcatttctatcggtacgataaagccccgccgccaccagtcccagccccagtttggtatccgtactgtaatgtggtccgccaataatactgaaatcaaatttcttatgattcttatctttattagcatcattaaaatagtccagaaactttttgaaaaaagtccttttctgtactgtgctgtctttgtgttgcgttgtcgtatcttcaggcaaataaaacagcccaccctcttgcgtgactgccaaagccgcatctgccatacatataaagattacgatccaaaatgatattttcttcattgtaatctattcttttttccactgttaaaacaagctttacagtaaacataaactgaataaaaacaaataaagcaggtctggatacaaagatagccaaacctgctttattgtgacttttttatataataagaatctggtctgaatttacctatttctgtcctaaataccttataccggttgcttttctgtaatcagccaacgcaatcttctgctcataataagattggataaggtttgtatatgcctgtatccatgtcagctgtgcagaaagcacatccaaaatagtcaacttaccttcagtataactaaaagtgttcaaatccaagttctcttctgccagtttgcagttctcctcggcaatacttatctgacgggtattctcggtcagactagtccacgccttcgccacttctttgcttatttggtcttgcttatcttgcaatgcatactgcttgcttaataaaatagccttctgtgcagccgtcgatttaaagcgggctccccaatggaaaatcggcaatttaatagaggcatacacattactattaaacatagtttcgcccgaaatgttcaacatctgtgttccccatgtctctttaaaaccgatagaaagagaaggattgtacttggcggcagccagacttacctgtcttttctgataatccacatccaactgtgagatagcataatcgggacgcacattcaaggctgtttccgctccaataaaggcaggcataggcaatatggtagaaatagaatccgtcaaatccatttcagccagcggttccaatcccatcagcacattcatattctgcaaggcgacctgataagactggtagctgctggaacgttgcaattcagcctctttcaaacgggtctgcatctgaatgagatccgtcttgctgatatagccatcatcgtacttatcttgcagcactttggtcaactgctcaataatctgcacatactggcacatcgtttcatacatttctttttgtgcggctgttccccaataactggcttcagcagcatagataatattatccgttgtcaaatccaccgacttatccgccatctgggtttgtatttgggaagccttgtaattgtgatagatgcttccaccggcataaataggttgtgatacccctacttcggcactgtatgaatcgtgctccataggaacagccattccgccaaaatccatctcgtatttgttaatacgatactgatagcttcccgttgcatcaacagccgggaagaaagcggtttttgccgctttcatagccttctgcatagctgtacgttgtgccacactctgttttaaggtttggctataatccagtaccttttgttcaaaggtagaataatccacgacagtctgagccgaaagtgtaccggtcatacaagccatacctataatatagatcatcttagttttcattatctgtctgctctgattttaaagaaaatacaataagttaccggaagaacaaaaatggtcagtaccgtcgatacgaacaaaccacccataatggtagccgccatacctgcaaacatggcatcgcccaacaatggaagcatacccagaatagtagttccggaagccatggtcaccggaacgatacgtgtcttggtagcctcgaccacggcagacacagccccctttccatccttcaactgaagtccgatttcatcgaccagcacaatggcattcttgatattcataccaatcaatcccaacagaccgaggatggcaaagaagtccaatgacttgccaaacaagagcaatccccataccacaccgataaacaccagcggcaacataagcataatcaataccggcttgcggtagttgctggggaaaagaaacagcagaaccacataaatcaacaggaaagtcagcggaatattcttcgccaatgcagcattacttacatcctgtgtttcctgctcaccgaaatatttcattttatacccttcgggcaactgcatctgctcttgtacggcagtaagcacctgtttaaacgcagccatcgtattggctccacgtttaggttcacattgcatcatcatacaacgctcgcggttaaagcgacggactacattataatcataacccaaagcgaaattatcgattacctgttccactttcacggaatttcctttcgtactgaatacaggcacacttttcacatcattcaagttcattttttccacatcctcatctttcagcaggataggcaaggaaacatccccctcacgatattctcccaaaggcaaaccattggtagccgtacggaatgagttggcaacctgctgacgggtaatccccaagcgtaaacctttctgttgagagaacatcggtttccacacgggcaccttatctccccagttggaacggatatccgtcaccatatcacactggcgggctatttttttcgccctttcaaccaatgcggtcaatgtatcgggattttcaccgataaaaccgatctcaatagcagcttcaggcaccggagacaaagcaaaaagtgccgaacgggtaatgatattgggaaagttctgagtcatgtgctcataaaactgctgttctacttcggctgcatcttcggggtctttagtttccaccatcacattggcatagttagacttcggtccaaaagaagaacttgccaaatagtaacgcaacggagtaccacccaatgtcaccgaatatgatttaactttctcatgattcttcaagtaatcctccaccttcatcacatcctgatctaccgcatgaatactaaatccctcagggaataccagatcagcacggaaataaggcttattcattttcgggaaaaaactctgaggcataacagccataataaccaaagaaagcaccaaagttacaaaaaccgtggtcaatgtcacaaaacggcgtttaatcagcaaggtcagaaacttctcgaatttatgatagagtttagtatcatacgggtctttcatcgcaccgccgggaacagcttctttcaaaataaaattaccaaaagtcgtagtctggcacaaagccagaatccagctcaatcccagtgatacagccaatacaacaaatagcggtttcacaatctcagccacggatgccggtgccagatacaaaggcaggaaagagcagatagcaataaaagtagcgcccagcaatgcccattgcggcttgatggctccctctatcaatgactgataacgtgattttccgcgcttgatacctatctgcgcattatctgtcaccacaatggcattgtccaccagcatccccatggcgataataaatgccgccaaggaagtacggttcaatcctaccccccacatcaacataataagcaaagtaccacctaccgagaaaagtaacgaactacctatcagcataccggcacgcgatcccatcaccacaaagataatcaggataacaataaccaatgattctatcaaattcaggataaagccattattcgcctcatcggcaatcttgtcctcaggataaagcgaggtcagttcaatgccgataggcaacaattgctctatttccgccaacctttcgtccactgctttacccacagctaccacattatcctttgctccactggccacacctataccgatagcacgtttaccattgacccgcatcaaggttgaaggcggatcataatatccacgctccactgttgcaatatcccccaaacgggcttcccgtccgtccttgctgataatcaactggttttctatatcttccagactggtataagtcccttccgtacgcaagcgcaactgataaatttctgtcgctatatctcctgtattcacctgtatgttctgcttctgcaaaatgcccataatcgaagtgggatcaatacccaatgccgaaagtttggaggtagatatcttgacattgatcacttcggtctgctctccgtataacattactttctgtactccctcaatcggagtcaactgagtacggatacgctgtgcccagtcacgcaaatcggtatacgagaagccctcatcagctgtcaaagcataataaataccatacacatcaccaaagtcatcatttacagtaatggtagacgccccactgggcaacttgggttgtatattcgccactttacgacgtaattcgtcccattttacaggcatataatccggatcaatcgtaggctgaagttcaatagaaatcttagacagtccgaaataagattccgatttaatctgatatacatctgtcatggattgaatttcacgttcaatcggttccgtaatcagtttctccacttcatgtggattcgctcccggatactgggtaaccaataccgcagtctttatcacgaaaggcgcatcttctttcttaggcagcttgaagaaggagattactccgcctatcaacaaaatagccaaaaagaaatagataaccttccggttctccaaagaatattttggaatattcatgatatgctctctccttttttattctgttaatatttttacttgctggccatctaccagataagacgctccggcagacacaacctgttcgcccggttcaatatttccggatactatcaggtcgttacgtcctacaataattccctcatcactgactttacgcagttctactttctgtgtagacggattatatataaatacgatcttgctattcaagttattatcaaacactacagcggacaaaggcactgttattccttcttttaccacatcattctcaatattgacaataacacggcaagaaaagcccaccgataccttatattttttcaaatcaaattccggatcatcaatgtaaaggaatacaggaactcctgccccatcgggagaagcctctacatactcctttacttttgcctgaaataattttcctttataggcatcaaattctacgtaaatagtagaaggagaagttacataagaaatattcgtttcggggatagtgaactccacttgcaatttagccggattaatcaaacacaccactccttgtcctggctgtacacgctgatagttttcaacatattttttttggataaagccatcaaatggagcgcgtagcttggtgtcattcaatgtgttttgcgcattttcaaatgccgatttggcattggtatacgaagcttgggtcgtttcgaactcttgcatggaaatagcattcttggccaacagtttctctgcgcgttgcatctgtgatgacgccttttggaatgaagccctcttagcgtcataatccagtttgtaatctgtcggatcaatttcggccactacctgtcctttcttcacccgttgtccttcgagtacattcattgctaccagcggaccggacattttaaatgccaagtcactgaactgatcaggcgacacaacacctgaatacgatttttcgatcctgcttaacgaggtcacttccgccaatttcacgggacgaggaccgcgttcttgtgcaggttgctgtccgcaagaacagaacactgccgcaatcattgccataatagacaaatttttacctttcatactgtttatcttcactattagtttcgctgcaaagttcttataattattaaaagcgtacaagtgctaacagtaagatatattagtctatttttaagcattttctttgttatctgctctaactgccctatatttgtggtgcataatcaaaaccttctttatttttatgaagtatatagatgacattaacttatttaaatcgaataaggatttcgttgcagaaattgacatgacaggatcattaggccgtatttaccactacccgcaacgaatggaaggatgcttgttccttctgtgcctgcgaggtgaatgtgacataacgatccatctgtctgaacacaagatacaaaagaacgacattgtcactattctgccagaaacctttgtacatgttcaccggcaaagtcctgactgtcgtctgtacttgataggattcaacaaagagttgctgaacggaataaatctcttcaattccaccatgaactatctttcagccctgattgacacgcccattatccctctgcgtcccgaaataaccgagttgtttcaagactatttcctgttgctgataaaaatgaaacgtatgggagccaagcccaataaagacttaatcagcaccatgctgctcactatattgcacggtgtaggcagcattcatcagaacaccaatgtaaccacacgtactttcaaccgtggagaagaaattgtgaaacgcctggtccaatatatcatcaaacattatacgaaagaacggagcgtagctttttatgccgacctgcttcatatatcccctcagcatctcagtactacagtcaataagattacgggaaaaactgttacagatatcatcgccaaactagtgataacagatgcggaagccaaactaaaatccacagaccttaccattcaggaaatagcctattcacttaatttcccagacatctcgttctttggaaaatactttaaaagatatacaggaatgtcaccgaaacagtatagggaaaacggatagtgaaaacagactcagcccacgttagtatgtgtaaggtcagacgttagtacgtataagcctacacatactaacgtataagcttatacatactaacattccaaagtctcttacacctatataaaagttataagtttttcggcttataaatagcgttccaccaagtcgcatcatcctgcaaccatttggcaaaccaggcaaaaatcgtgttctgccactgaatcctcttgccataatccactatatgatgatcttgtcccgttacagccacaaaagccgtttcgcgccccagtaacttaagtgctgtaaacatctgaatgctctctcccaccggtacattcacatccgcatcaccgtgcaagaacagcaaaggcgtatgtatcttgtccgcattgaacaacgggctttgttttacaaaaagatcaggattgctccacggataactattcgccatggaaacttcactgtacgaatatccccaatatccttccccccaataactggtatgatcactgataccggcatgagagatggccgctgcaaaaatatcggtctgtgtttgcaggtattgtgtcatgaagccgccataggatgcacctatacagcctattttcttgtcattgacaaaagcatgttctttacaaaactgctttgtaccttctatgatatcctgtgccacccctgccccagctgtattgacgtggcgggcagaaaattcctgtccgaaaccggtagcaccgctaggttctatcacatacaccacatagcccaatgccgcgtatgcatgatgcggataacggctttcgaaattacggctgaccggactgcacccaccataataattcacaatcataggatatttccggttggcgtcaaaatgaggcggcaggtaataacgaccataaatggtatcaccacgagaattggtaaaactccaggccttgcattcgcccagctccacatctttcaatatgtctttacttaagtcttccaacaaagatgatttcatctttttggtattcatggtgtataaacggtcggaatttgaggcgctctgtccataataggccataaccggagcattttgcgccaatgagaatgagttgaccaaatcttctgaaacctccagttgctgaattttcccatcagcgggattcatccggtacaaactgtaacagtcacggttctcggccgtgaaatatatttgcccgtcggccttattccacacggcacgctgtacgctgggattaaaatctttcgtcagcggagtgactctcttatcagctatattcagcaaataaagctgaccgtccgtcatactcggagtctgcccctcctttacatttttccctattccacccagcgattcaggcgagccggataccaatacctgcgttccgtcaggtgaaaaacgggctccactgataaaaccatctttatctatcagcagttccgcctgtaaagtctgcatatccaaccgatatagtgagaataaagtagtaggacgcttggtcagacggctctgactggtcatcatcaaaagataccggccgtcattggaaatatcggcagcccagacattgtgataaccgaaagtcagtggctgcaacaaaccggtcttcaaatcatatttagccagataagaacggttacgccaccccggctggcggtcatccggttccagtacctcataaatttctttacgttctttcggaccttcctgggtcatggtgaaaagcaggtagtcttccgtaggtgcgaactggaaatacccgtcaggtaatttattcaccagcacagtttccattccggtaagcggatccacaactatcagctgcctgccatccactcccgtacgggtataataataacggttagaacgaggcatccattgcatattttcagtacgctccgccaaaaccttaccgctggcaagttcagtaatgcgcgtactaccggccgaccgaccacctacataagtcgtacgataattggtaatcaaatatctgccatcaggggaaagccctactccggcaaaacgagttccatgcaacacatccgccaaagtatatagctttttgttatcttgcttaagtgaaatgcttccctcttgatccgtatccacactcactttcaaggaatctgttttccctgcttcagaaagatatttaataactacagaatgggtggccggctccaaagcgagttcagtcccttcctgcttctttccatctacataaagctggtatcttttcaacccttcaatcttcagcttggctgtggcataacgagtattctccaacacaaaacccatcatgtgcaaggcatatcccgagtcacttcccggcaaaaccccgcctgtaaataaagttccctgttgcaatacgtccacagaaagatgagtatccaacagacgtccggatacaaaagtctttgaattcacatccacgctgtccacctgaaaaggggcctgtacaacgtagggtccggcataacggaaagtagtaatgtcaatcgtttcagcacctgccatcacagcccaggcaagtgcacaagacaataagatttgtttcttcatatttctaacaatttgtgttacacaaagatatgaaatataaaagaaacaaaaaccttttcctacgaatttcaatgcttcctacaacatattatttcacctctcccggcagatagcgtaactgcaaatactgttcccccggtttcagatatccgccttcgaatatttctttcctgatccggtaaacttccactcttttcaataagtaattttctaccttcatcggctgctttttacaccaggaaagcactttcagacttccatcggcatgaacatccgcataaacctttaccgttcttatcggagtcccgtccgttatcttacgtcctcttttataatccacccacaaaatagctttcgctttttccccctcacatgttccggcatactcatccgtttcggacgcggtggaaggtgaagaagttcccttacaacctacaaccacacataaaatcaaaagatataaaatatagcttcctcgtgttttcatatcaatcggattagtcttttatctcttctataggagtaatatcctctatttcaggcatccccggttctttcttctgacggaagcggatgatgtttatcaaatcggacagtccgtatacaatgctgctcactcccagaatgatgaatggaacagcagcagccgtaaatggattaaataataccacaatacctgcaatcagcaccaacacaggtatcacaaagaaacctcccggtaccaccgtccaactacgcgcagcagataaattcacaatctgactgattcccgccagtaccaaaacagcacccagcacatacatcaggataccgacaaaaaatgccggcataatcatcagccataatccgaacaaaaggctgccaagcccggcaataggaaaacgactgccatcctgcttgccacgaatcaaatacccggataaagaaaagagtcccggtactagaaacaacacaccgattgtaataaccagataaagaatggcagcctcaggccatgccaccagcaacacaccgatgaccaacgcacagatacatctgattatagaataattcattgttttcatattcaatcatgtctaattggttaatgaagcgaatatactgattatttctgagaagacagatgcaaaatggatattaattttcagacagaagaacaaaaaaagaaagccaaaacaaattttcctgccataagcttagaactaattctattgttctatagactttagcaaacagaatgttataccgactattccaatctattctttcgtacccatgcctgaagatcatccttttgtcttatgacaaatcactctatctgttctgtttcaggcagactttgttcattctcgtcctcatcgatcaaaatagcccaaaagagccaccataacagcaatcctgccaacaacacggcacctattcttatccaaagtttacgtttcatacacttcattttaatgatttattaactgatgtattaaaaccattccgccacccgaaatgttcatttataaaaccaatttaaagtaataagattatgaataatggaaaattctttgccggactggcactaggagcgctggtcggcagtgcattaagttgttttgcgcacagcaacagaggtcgcaaattgagaagagacgtgtatgatgccattcaggacttacaagaagatgcaaaagacctggctcatcatgcaaaacataaagcagaagaagtaagcagtgaagtagccggaaaagtaggtgagaaagtggaagaagtgaaagggaaaatacacgaagctgcaaataaataaaaaaaaagtaagtttttctttggagtttaaaacaaaacgcttacatttgccccaaaataaaaacagattttatgaatagaatcatggtaaatacatattggtggcgtttcttacaactaaacaagtcgtaagggaaccagaccatgtatatatacctgacattctaaaaggatattcaaactgaaggcctgtcgtacttacgacaggccttttttcgttagtgcaattaacattaaaatatagaacgacaatgaaaacttatcaggtaaacaaagaaggttattatggcgaatttggaggggcgtatattcccgaaatccttcaccgctgtgtggaagaattgcagaatgcctattccaaagtattggaaagtgaaggattcaaacaagaattccaccagttactacgcgactatgtaggacgcccttcacctctttacctggcaaaccggctaagcaagaaatatggctgtaagatctacctgaaacgtgaagatttaaaccacaccggagcacataaaatcaataatgccatcggacaggtgttactggcaaaacgtatggggaaaaaacgtatcattgcagaaaccggagctggacagcatggggtggccaccgctacggtatgcgctttgatgaacatgcaatgcattgtttacatgggcaagaccgatgtagaacgccagcatatcaatgtagaaaaaatgaaaatgctgggagccgaagtccgcccggtcacttccggcaacatgacactgaaagatgctacaaacgaagccatccgcgactggtgttgccaccctgccgatacttactatgtcatcggctctaccgtaggccctcatccctaccctgatatggtggcacgtctgcaatccgttatcagcgaagaaatcaaaaagcagctgaaagaacaggaaggaagggaatatcccgattacttgatggcttgtgtaggaggaggaagcaatgcggcaggaaccatttatcactatatagatgatgaacgtgtgcagattgtcctggccgaggcaggaggcaaaggtatagacaccggtttctcggccgctaccatccaactggggaaaatgggaattatccacggagcaaagaccttggttatccaaaacgaggacggacaaatagaggaaccttactccatctctgccggtctggattatccgggcataggacccatgcatgccaatctggccaaacagcaacgcgctttggtactcgccataaacgatgatgaagccatccgtgccgcatttgaactgacccggctggaaggtatcattcctgcattggaatcggctcatgcattgggagcattggacaaaatgagattcaagccaacggatatagtggttctcaccgtatcaggacgcggagataaggatattgaaacctacttgaaagaatccggcacaagggcctccttgcaataacacatagaaacccatgagaacaaaaatcctatacggacaactataaacagaaaagaaacaatgaaaacttttacctataccacccgatgcaaaaccatactgggtgacctgcatacaccggtcagtacctatctgaaagtgcgcgacattttcccacagagtgcactgatggaaagttccgactatcatggaagtgagaacaaccgttctttcatcggactgaatcctgtagccagcatcggaatcaaccatggcacagccactgccacctaccctgacggcagcatggaagaacatcccatcagcgaacatttccgggcagaccatgcgatctccgattttctgaatcgtttcaaggtaagcggagaatacaacaactactgcggactgtatggttataccactttcaatgccgtacgctatttcgaacatatcaatgtaaaagacagccgtgatcctaagaacgatgctccggatatgttgtatatcttatataaatacctgattgtcttcaatgacttccgcaacgaaatgttattactggaaatgttgcaggacggtgaggacagccatctggattatgtggaaaaagcgatccacaaccgtaactataccacttacgacttccgtgccgtaggcgaaaccaccagtaccctgaccgatgaagagcataaggcgaacatccgcaaaggcattgcccactgtatgcgcggcgatgttttccaaatcgtcctttcacgccgttttatccaacgttacgaaggagatgatttcaaactttaccgtgctttacgcagcatcaacccgtccccctacttattttacttcgatttcggaggcttccgtattttcggttcctctcccgaaacccattgtaaaatagaaaacgggcgtgccaccatcgaccctatcgccggaaccacccgccgcaacggagacaagaaaatagatgctgaactcaccgccaacctattggctgatcccaaagaaaatgcggaacatgtaatgctggtagatctggcacgcaatgacttgagccgcaactgtcacgatgtacaagtagaattttacaaagaagctcaatattacagccacgtcattcatctggtaagccgggtcagcggcgaactgaaccccaaagccaatcccatcaaagcatttattgatactttcccggccggaaccctgagtggcgctccgaaagtaaaagccatgcagctgatcagcgaatacgaacctcacagccgtggagcctatggcggctgtatcggatttatcgggctgaacggcacattgaaccaagctatcaccattcgtacattcgtcagccgcaacaacgaactatggtttcaagccggtggcggcatcgtagctaagagcaatgaagagtacgaattacaagaagtaaacaacaaactgggagcacttaaaaaagcaatcatcctggcagaacaaatgtaaaaacgaatcatcatgaaaacagtaattatagacaactatgactcatttacctacaacttgagtcatttggtaaaagaactgggagccgaagttaccgtattacgtaacgatgctttccaactggaagaattggaaaaattcgataaaatcattctttcacccggtcccggtattccatcagaagcaggcctgctgctcgaagtaattaaaagatatgccggcaagaaaccgattctgggtgtatgcttgggagaacaggccataggagaagcttttggcggcaaactgaccaatctgagcgaagtatttcatggcgtacagacccccatctcaattaaaaagaaccaatcaaaagacaaaggaaagaaaaccgattacattttcaacggactgccggatgaagtgccggtaggacgttatcactcatgggtggtagatacggacggtttccctgagtgccttgaaataaccgcagtaagccaggaaggtctcgtcatggcattgaaacataaagaatacgatatccacggcatccagtttcatcccgaatccgtactgacccccgatggtaaagccatgatagccaactttctaaacgcataaccccaaccgtacataataaatatgaaagctatattatcccgcctcttcaatcacgaggaactgaaccgaaaagaagcaaagaatttgctgctcaacataacccggggaatgtataacgacgcacagatagctgccctgctgaccgttttccaaatgcgcggcatcaaagtagaagaattgataggtttccgtgaagcattgctcaccacccgcatacctatagatttttccgcttacagccctattgacattgtgggtacaggcggtgatggaaaaaacaccttcaacatctctacttgcgcctgcttcattgtagcgggagccggatatcacgttgccaaacacggcaactatggcgcgacttccgtcagcggagccagcaatgtcatcgaacaacacggcgtaaaattcacgaacaatccggataagctgacccgttctatggaagaatgtggaatggtctatatgcatgcccagttgttcaatcctgccatgaaaagtgtaggccctgtccgcaaagcactgcaagtacgtaccatattcaacctgctaggtccgctggttaatccatgtcttccggcttaccaacttctaggagtcgccgatctgccgcaaatgcgcctttataccaacgtgttccaaaaactgggcattggctttgccgtagtaaacaatttggacggttacgacgaaatctcactgaccgatgaattcaaagtgatgaccaatcactacgaaaccatctacaagccatccgaactaggcttctctctcgccagacaagaagaactttatggtgggaacactcccgaagaagcgtcgaaaatcttccataacgtactggagaacaaagccaccaaagcccagacagactgtgtactgattaacgcttcttttgccatacaagccatggaaccggccaaaccgatagaagaatgcgtggccatcgcccgtgaatcattggaaagcggaaaagcattgaatacattgaaaaaatttgtggaactgaacagttgactacacacccggtattccactaccaaacgcctcatacaatgacagatatattaacagaaatcatcgcctgcaagcagatcgagatcgaactgcaaaaggctgccatcagcaaagaaatgctgataaacaattgtaacgaacccatgccacgtatcagtatgcgtgccagtcttgcctcttctccttacggcatcatctccgagttcaagcgtcgctctccctccaaaggatggataaaagaagacgcacaggcagataccattcctcccgcttacgaagcggccggagcctccgcactttccatcctcaccgatgaaaaatacttcggcggcagcctgaaagatatccgttcggcacgcccccacgtgcaacttcccattctaaggaaagatttcattatagatgaataccaactttatcaggcacgcatcgtaggagcggacgctatccttctgatagccgccgctttgaagaaagagcaatgcaaagccctagccctcaaagcccatgaactggaactggaagtcctactggaaatccacaacgagcaagaactggaatatatagacgagaacattgacatggtgggagtcaacaaccgtaatctgggaagcttccacacagaggtggaaaactctttccgtctggcggaaaaactacccgaagaaatgctccggatctctgaaagcggcatctctagccccgaaacagtcaaacaactccgggctgccggcttccgaggcttcctgataggggaaaacttcatgaaaacacccgcaccgggagaagccttaaaagaatttataacccaactagagaaatgttaggatgaaacaacaatgattatcaaggtatgcggtatgcgcgagcccgaaaacatacgcgccatagagcaagccggagcagactggatgggcttcatcttcttcccccaatctgcccgctacgtatcacatcgtccggaatacctaccggaacaatgccaccggatcggggtcttcgtcaacgaaagcagcgaaaacatcctgctgaaagcacaggaattcggtctgcaccatatccagttgcatggcagggaaacaccggaacaatgtcgcaaattaaaagcaaccggactgggagtcattaaagttttttccatagcacaggaaagtgacctgcaatccgccggttgttatgagggcgtttgcgattactttcttttcgatactgcctgctccggatatggcggttccggcaaacccttcaactggaatatcctgcaagcctatcggggaaagacgcctttcctactgagtggcggtctccgtcccggcagtctttcccttttgttgcaattcaagcatgaacaatgggcaggcatcgacctgaacagcggattcgagaccgctccggctctgaaagacgccgccgccgtccacacatttataaaccaattaaaacaaaaaatacaatgaacagaatcaaccagttattcagtaccaagcaaaaagacatcctatctatttatttttgtgcaggctttcctaccttagaaggtacggcaagcaccatcaaagtcctggaaaaaaaagggattaacatgattgaaatcggcattcctttcagtgacccgatggctgacggtcccgttatccagcacgctgccacccgcgccttgaaaaacggcatgacactgaagctccttttcgaccaactgaaagatatccgtaaagaagtacagattccgctggtgctgatgggatatctcaatcccatcatgcaatatggattcaaggatttctgccgcacctgccgggagacgggaatcgacggagtgattatccccgacttgcctttcaaagattatatggaggaatatcgttccatagccgaggaacaagatgtgagaatcatcatgctcatcactccggaaaccagtgaagaacgtatccgcctgattgatgaacacaccgacggttttatctatatggtatcttccgccgctatcaccggtgctcaaaaagatttcaacgcacagaaacaagcctatttccaacgcatcgccgacatgaatttacgcaatccccgcatgataggtttcggaatttccaataagcaaaccttcgaaaccgcatccgctcatgccgcaggagccatcatcggcagtaaattcgtgaccttgctggatgaagaagacggagatacggaaaaagcagcggacaagctgctggaagccttgaaaaactaacctttcacaactcgtaacatcctcttcttcaaaaattcacctgaaagatcatggcgatacaagtgaaaaatataataccttacaggtataagattatatatcttgcagcagtaagatctataatcttatacctgatctttctacttcttccatccacagcatccggcagaagcagttatcacctataaagaaaaacattttgttatttccctctcttatttttgtcatagttacacataattactatctttgtgccaaaattaaacaagaaaagcgcatgacacagagtgaatatccttccgttttgctaatatacacaggcggtacgatcggcatgattgaaaatcctgagacaggtgcactagaagccttcaatttcgaccagttacaagacaatgttcccgaattgaagcggttcaactatcgcatctcctcttaccagttcaatccccccattgactcttcggatatggaacctgccttgtgggccaagttagtcaagatcatcaaatacaattatgacaattttgacgggttcgtcattctgcacggtacagacaccatggcatacaccgcttcagcgctcagcttcatgctggaaaacctgagcaagccggttattctgacgggtagccagctgcccatcggcatgttgcgcaccgatggaaaggaaaatctgatcacttccatagaaatagccgctgccaaacatccggacggcactgctattgtacccgaagtatgcatcttcttcgaaaaccatctgttgcgcggaaaccgtaccacaaaaatcaatgcggagaatttcaatgcgttccgttcatacaatttcccttcgctggcaacagcaggcatccacataaaatatgaatatgaccgtattcacaaagccgatcccaatctgccattaaaaccacactatctttatgataccaatgtaattatactgaccctttttccgggcatccaggaaaacatgatcagcaatatcctacatacaccgggattacgcgcagtggtattaaagacctacggttcgggcaacgctccgcaaaagccgtggttcatcgaacttctaagggatgccacctcacggggaatcatcattgtcaacatctcccaatgctctaccggaacagtggaaatgggaaggtatgaaaccggactccatctgctggacgcaggggtcatcagcggctatgacagtacggtggaatccgttctaaccaaactgatgttccttttgggacacggaaaaagtgaaaaagaaatacgttaccaaatgagtattccggtagccggagagtttacgaaatcataatttattgcgttccaattatcatctgacgggatgattgcagaatcattaaaatggtgtaatctgcgatgaaaacttaacgattttataacatgtaatctttttgtaatatttgtttcatcaaatagtaataaaaatgctccatctttgcaatgctgatcagaaaagattagttttgtagtattaaaaagatggatatatgaatgattaccgcattttagtagttgacgatgaagaagatctatgcgagattcttaaattcaatttagaaaacgaagggtattttgtggatacggcaaactccgccgaagaagccctgaagatggaactgacccaatacaacttgctgttgctggatgtgatgatgggagaaatatcaggattcaaaatggcgaacatgctgaaaaagaataaagctactgcttctattcccattatattcattactgctaaagatactgaaaacgataccgtaacagggttcaacctgggagccgacgactatatctcgaagccattttcactgcgcgaagttatagcacgcgttaaggctgtccttcgacgcaccagccccacacagggaaaagaagcgcaagaacaattgcagtacaaagggcttttagtcgacatcaccaagaagaaagtcagcatagacggtatagaaatttccctgacaaaaaaagaattcgaaatcctgttgctgttgttacaaaacaaaggccgcgtattctcacgcgaagatattctggctaaagtatggcaggaggaagtctatgtgctggaccgtaccattgacgtcaacattacccgcctgcgtaaaaaaataggcgaatatggaaaatgcatcgtcacccgcctgggatacggatactgttttgaatgcgaataacctaacctgtacctttccatgactattaaattatccagccacgtcctgtcattcaacaagaaactattcttgtcggtaatttccttattcatagcattcgccatctgtttcatggcattccaatatcgcagggagaaggaatacaaaatagaattgctgaacacacaactccagaattacaacgaccgcctgaatgattttctccgtggcagggatacactgaatattcaacaattgaacgactatgtttgcgaacacacctttgaagatctacgcgtgacactgatcaataagaatggtactgtaatttatgacaatctggaaaaagatcccagccacttcgagaaccaccataaccgtcaggaaataaaaaaagccatcatttatggcagcggctactccattaacagacaatcggaaagcttgggcggtgaatttttctattcagcaaagtattatcctaacctggactatatcattcgttcggcccttccctataatgtcagtctgatgagacacctgaaagcagactctcattatgtatggttcacactgataatcagcctgatattaataattgtgttctaccggttcacacataaattgggaatgtctatcaccaaattgcaacaatttgccatgaaagccgaccgcaatgaaccgatagacactgatatgcaggatacctttcccaaaaacgaactgggcgagatatcccaacatatcatccagatttacaaacgtctgcatcaggcaaaagaagatttatatatcgaacgcgagaaactgatcacccatctccaaatctcgcacgaaggcttaggcgtattcaaccaccgcaaagaagagattctggtaaataatctgttcacacaatacgccaaccttatctcggacaaaaatctgagttctacggaagagatcttctccatccccgaattgcagcccatcacccgtttcattacaaaaaacaaggaacgcagtatcggcaaagaagagaaacggatgtcattgaacatagacaaaaacggacgtatctttgccgtggaatgcattatctttcaagatgacagctttgaaatctccatcaatgacatcactcaggaaaaggaacaggcacttctgaaaaaacagctgacacagaatatcgcccacgaattgaaaacccctgtaagcagcatacagggatatctggaaaccatagtaaacaatcctaccctgccccgtgagaaaatcaatgctttcctggagagaagctatgcacaaagtaaccggctggcacatctgttacgggatatctccgtacttacccgcatggaagaagctccgaacatgatcgaaacagaaccggtaaacctcaccaccatgatgcggaatatcctgaacgaagtaactttggaactggaagaaaagcagatcacagcccacaacatgctgcctgaaggactgactgtacaaggcaattcttccctgctatactccatcttccggaatctgacagacaacgccattgcatacgcaggaactcatatttccataaccatccgctgtttccgtgaagacgaacgtttttattatttcagtttctcggacacaggcgtaggagtaggacccgaacatctaagccgtttgttcgagcgtttctatcgggtggacaaaggacgttcacgcaaactgggtggtaccggactgggactggccattgtaaaaaacgcagtcattctgcatggcggaacaatcttcgctaaaaatacccccggtggaggtctggaattcatatttacattgagtaaagaatgagaggataccaagagcctgtttctaaattttcttcaaaatttaaacaggctctaaaaaataaagaaagataattgttttcttaaatataaactgtatctttgcggtgcatcggttcatttatctcccctccgaggtgaatgattaaaagggaatcaaggtgaaaatcctgaacagtcccgctgctgtatgtttcactaaacgcataagcaaaatgccaataaccactgggataatttccgggaaggtgcttatagcggaaacgagtcagaagacctgcctgtgcatttatcaaatctgaagctttcgaggaaagagcttggaacactgaacgtaagggatgcctttaatcacatccgctattttctccgtttcactgtccggaaaagagtatcaggtaaaaagaacatttattttaaagtaaactctgccaagtttatttggaatgctcagccgaagtgattcgcctgagcattattttataatccaagtcaatacaaaatcgggatgagtgacataacggacccgataacgttcctgccggcctgtacgatattcgcgtgcctcgaactccccctcttccgacaggctgaaaggaaaaatacgaagatgacgaataaaatccacctcctctactcccatcagtttgaacagtgcctccttggccgaccaatggagcaataaagcataaacgtcatctccttccatcattgcgggctcttcatcggaacgaataaaacgggaagctactttccgcactctggttccatactgctctatatccactcccacctcacaggaagaatgaagcgccaccgccacataaccgcgagtatgcgagatgctgatataccggcttccatcctttagataaggccttcccgaagagtaataagctatctccttttcttctccacacaaagccttcagcagcacacgtaccgacaaccattcatgcttccgtttttcggaaagaacagccagtttctccctataccagtctttatgctccaatgatgccagcagttgttccgttgtttcatcagacttccatattccaagcagaaactccccttcgctataagtacggtataaaggcataataaaatctatttcttttcttcttccacggagctggaagagtcaacgataacttttactttcaaaatgcggcgcgtattcatttcaagtacctcaaaatgataattcccataatctaaccgctcgtgcaatacaggaaactccccttttatttccagcaacaaaccagccaaagtgtccgcatctccttccactttctcgaaaagagcgggatcagctttcataatcttataaaaatcggacagcaaggtttttgcctcgaatatataggtacggtcattcagtttcacatacgtacgctcttcatcatcgtattcatcattaatctctcctacaatctcctcgatgatatcctccattgtaacaatgcccgaagtacctccaaactcatcgacaacgatggcaatatggatcttgttcgcctgaaaatcacgcaaaaggtcatcaatcatcttcgtttcaggcacaaagtaagcaggacggaccaatgtctgccaacgaaagttgtcgcctttgcccaaatgaggaagcaaatcctttatataaagaattccctttatattatcccgcgattcggcatataccggaatacgggaataggcattttccacaatacatttcaacacttcggaataaggagtattgatttccaagtccaccatatccagccgggaagtcatcacttccttagccgtttcctcaccaaaacggataataccttccagaatattgctttcctctgaaatctcactcttgtccgtcagttccaaagcctgtgaaagctcgtcgacagaaatattataattcctttttgccacacatctgttcaccaaaaaggaagaacggaccagcaatgccgacaaaggtgaaaagaatttctttaaaaaagaaatggcaggagctgccttacggcaaaacttcaacgtgttctgtgccgaataaattttaggcatgatttcaccgaaaagcaacagcagaaaagtaaggacaaccgttattagcaagaattccagaatcacggaatttccaaagtgtatggtgctggcaaaaaagtaattgcacagcatgataatggttacattgacaaaattattagagataagaatagtcgctaacaagcgttcggaatcattcagcagggcgctgatacgcctgtccgaagtatgttttccttcctctatctcacttaaatcaacaggtgaaagagaaaagaaagctatttccgaagcagacacaaagcctgaggcatacaacaataaaacagctaacaagatagctatgatagctcctatggtaggagctgttacggttacaccgtcaaataaatccgccaagcggcataaatacgagtcagggtccaaggaatctggttttagttaaacatcaagttctcttaattaaaaaggtaaatcgtctgtcagactattatccgaggcttgctgttgttgcggagccgcttgtgcagacacctgctgccgggataccgcttgtgcctgcggtacatatcctgtacccggttgctgcgaggtgttacgcggggtcagcatctccatattatcagcaaaaatctcgacaatggtacgttttatgccattctggtcatcgtatgaacggctgcggattttcccttctatgtagagtttgtcgcccttacggacatatttttccgcagtttgggccagtcctctccataacacgatattatgccattccgtacgttcgggaacctgtgttccattctgcaacgtataggcacgatcggtggtggctaacgagaaagtggcaacggcaatgccggtatccaaatatctcacatcagggtcctttcctacatttccaatcaaaatgactttatttactgacattctattattcctttttaattattaggctccaaaattagcgaaaaaaactgattcaccaaacgcgatacggcaaatttatgcaaatcttccacgcttattctctgatacttcgcaaaagaagccgaattctcagggagaatcacttcataaaaatttgcgtaaatcacccggtgggataacacgtgcttcacccctttccgcaccagccgcactatgggctcctctcccccggccagcatcccgcgaaactgtggcgatgcatacagttcctcttccgtccactcacgatccgtttctatcaaaggcggttcatacaaatttttccatatatcatttccgctgcgcttatgtataaaggtatacgcgcccatacgtacatatatataattaaaataacgattggtcaccttggttttatgttgcttcacaggcaaagagccggcaatccccttcagacgcgccacacaagaatcgtttagcggacaaaacaggcagtcgggcgctaccggagtacactgcaaagctccaaaatccatgatagcctggttgtagagaccagggcgctcacggtccagcaactcatcggcaacccggacaaacagtttctttccttccgccgaatcaatgggggtatcaatgcccaaccagcgagacagcacccgatacacattaccgtccaccactgcgtatggcataccgtaagcaaatgaacaaatagccgctgctgtatattctcccactcctttcaaagcacgcaccccagtgtatgttacaggaaatcctcctgcctctgccatccttctggccgcagcatgcaaatttctcgcacgagaataataccccagcccctgccaatatttcatcacctcatcctcatcggctgccgccagtgcgaacacatcaggaaaacgggccacaaaacgttgatagtaatcatatccctgaaccacacgagtttgttgtagaataatctccgagatccatatcaaataaggattttttgtccttctccacggcaaatcacgcccgttttccctataccaatctatcaattttctgctaaaattctccatatcagtattatataaaagtgcattctatgcaatatttccgcaaaagtaaaccaagaaaatggaagaagatgctttttttaggaaatttattctgaatatatttcttaaagagggagaaaagctatatatttgcagtccaaaaaattaagatataagtataacaataattatttagcgaaatgactaaagcagatatcgtaaacgaaattacgaaaaataccggtattgacaaggtgacagtgttaaccacacttgaggctttcatggatacagtaaaggattcattatctaaagaagaaaatgtgtacctgcgtggttttgggagttttgtagtgaagaaaagagctcagaagactgctcgcaacatttcaaagaacactacaatcattattccggagcacaatattccggcatttaaaccagctaagacatttacattatcagtaaagaaataataaacaagagtattaacccataaaatttgaagctatgccaagcggaaagaagaaaaaaagacacaaaatgtctactcacaagcgtaaaaaaagactaagaaagaacagacataaaagcaaaaaataatttgtagtctgtctgtgacgacaaataaagaacaaaccttgcaaagcaacaaaagtctttcaggtttgttctttgtttaatgagaaaagtgaacaatttaaaaatacaaaagtgacaagcgaactagtagtagacgtacaacccaaagagatttccatcgcactccttgaagataaagcgttggtggaatttcagaaagaaggaagaagtgcttccttcaatgtgggaaatatgtatttgggacgggtaaagaaactaatgcccggccttaatgcctgtttcgtggatgtcggctttgaaaaagatgcttttcttcattatctagacctaggtcctcaatttcattcttatcagaagtatctgaagcaagttttaagcgaccgtaaaaaactttttcccatcacaaaagctactatgctgcctgatattgaaaaggaagggacggtttcaaccaccctccaacaaggtcaggaagttattgtgcagattgtaaaggaacctatctcgaccaagggccccagactaacctgcgaattgtcattcgccggacgttatttggtattaatccctttcaacgataaggtttcggtatcacaaaaaattaaatcgagcgaagaacgcgcccgtctgaaacagttattgcaaagcatcaaaccgaaaaacttcggagtgattgtacgcaccgtagcggaaggcaaaagggtggccgagcttgatgcagagcttaaagtcttgctgaaacattgggaagaaacaatcactaaagtacagaaggctcccaaactgccggcattggtatacgaagagaccagccgtacagtggccatgttgcgcgatcttttcaatccgtcttatgagaacatctatgtgaacgatgaaacagtgttccatgagattaaggattatgtatcacttatcgcccctgaacgagccgaaatcgtaaaactgtacaagggtcagcttcccatattcgacaatttcggtattaccaaacaaatcaaatcctctttcgggaaaaccatttcgtataaaagtggagcttacctgattattgaacacacagaagcacttcatgtagtggatgtcaatagtggaaaccgctccaaatctgccaacgggcaggaggctaacgcactggatgtaaacctgggtgccgccgacgaactggcacgccagttaagattgcgtgatatgggtggtattatcgtggttgacttcattgatatgaatctagcagagaaccggcagaaactgtacgaacgtatgtgccaaaacatgcagaaagacagagcaaaacataacattctgcccctcagtaaatttggattgatgcaaattacccgccaacgcgtgcgtcctgccatggatgtcaacacgaatgaaacctgtcccacctgcttcgggaaaggtagcataaagccatccatcctttttacggatactttggagagtaagattgactacctggtcaacaaattgaagataaagagatttacgctgtacatccatccgtacatcgcagcatatgtgaatcagggtctggtttccctgaagcgcaaatggcaaatgaaatacggattcggaataaagattatcccagaccaaagtctggccttcctgcaatatcggttcaccgatgttcacggtgaggagatagacatgaaagaggaaatcgaaatcaagtaaaagaaaagggagtgataaaaaatgtcactccctttctttatttcacgactctaatatgcaaggcttgatttcgaagtttcacaaactcaaacaccagtcacattctgccgattataactcacccaaccatcacaaagctggcaaaacaaaagcacatccgttgcccctattttatttgccttgcttatagtctttcactattccctccgcaatccaatttgccaatgcctgacggttattcttcagaaccagccgttgttggtcacgcttgttccggatatttcccaattccaaaaacaccgctacgggagtcgtattacgcaatacatacaaattacgttcactcaccgttccgcgaaagccacggtttggctgatgcttgtcatatttcctatcaaaggtacggtgcaagttattggccaaccgcctacccttcgtacttttaggagcgttataaaaaaacacatctgtctgctgtcccttactgcgactgtccacatgaataaatacagctcgtttgtaactgctcttatctttccgatacagtttattcacccagtcacaacgttgcttcaaacgagccacctgattcaagggaataggatctcccatgcaagtttcacgtttactgtttgccaggacatgaccgtcacgaataccatctttcttatcttgaatgataatatgcaccttcgcaccgcgtgacaacaactcacgtgccaaccgcagaataatatcgtatgcatactcatcctcatgcaactgacgcccctgatagataccgatggccccaggatcgggacctccgtgaccactcaccaaataaaaacaagctccgcttagttcattggatgtaatctgataggtagcatattcctttccaaataatgcctctttgccggtacgaggctttttcttcgccagaagcggtgatagaacaaaaaataaaaacgtgacaaatagtaccgatcctctcattatctgttatttttctcccaacatttcatctatcttcttgcacaaagaagagaattcttcttcattgtacaaacgggtcagcattacaatcttgcccgttttgtcaatcaatacattacgggtgatgcccgctttacggtctgcatatctggcaaaaatatcagctcccggatcaagagccaacggataggtcacgccggtacgtttggcaaaagccactacggtttccaaaggttcgtcccgatccactccaaagagagcaaacgctttattatccttatgtttcaaccagatatctttttcaataaaaggcatctcttttcggcaaactccacaccaactggcagtgaactgaagcatcaccaccttgccacgcaaatcagagagtttcactttctgtccgtctgtcagttccatttcaaaatcgggagccatatcccctacctttactatataaccggcattatcaggagtaacctgttgtgccttcaccggctggttcagcaaacatgcgcaaaccagcaacatcagactcataaacttcttcatcgttcttctcttatttttatatattcgctacaaagataggctattccatcattttttcgtaattttggcacccaaaataactaccaacttatcaagaagatgaatattttttgggatacaatcactcattacaatgcgggtacctggatttatcaagttattatcacccttatcggcattattttaacctgttctctattcaaaagccccacaaaaaaaataaaagtagcgatgaagttatatctcatattcttgaatgtatggatagcttccgtgtattacatgatttattgtgaaccaagaagttacaacaatgctttggcaggattttggggaatcatggccatcttctggatttatgacctgaaagtaaactacaccccttttgaccggactcacaaacataccgcactagccgtcctgctttgtatgttgccattggcctatccactcttctccattataagggggatgagctttcccatgatgacctcacctgtaatgccttgttcggtagcggttttcaccatcggactgctgctggcattttccaaacgagtcaatatctttctcgtcatgtttctctgccactgggcactgatcggtttcaccaaaacttactttttccatattcccgaagattttctgctggcaagttcggctgtaccgggcctttatctgttctttaaagaatacacagcttcccatctgcatacttccacccttttccgtgcccgtatgattaatctcgccctgattattgcctgcggtgcaatcggagtgctgttcatgatatctatggtgtgcgaactggctcaagaacaggctttatcgaaataaaaacacgtcttaatgaggtactttgcaaaatctttcgtatttttgccaacaaattgagttaatgttttaacaggatgaacgtattagaactaagtgaacaggagattatcagacgaaacagtctgaatgaattgcgcgctatgggcatcgagccataccccgcagctgagtatgtaaccaatgcattttctacagatataaaagctgagttcaaggatgatgaggaacctcgcaaagtatcggtagccggacgtatgatgagccgccgtgtgatgggtaaagcttcatttatcgaattacaggattcaaaaggccgtatccaggtgtatatcacccgtgatgacatctgcccggatgaaaacaaagaaatgtacaacactgtgttcaaacgtctgctggaccttggtgactttatcggtatagaaggattcgtattcagaacccaaatgggtgaaatcagtatccacgctaaaagactgaccgtactgtccaagtctatcaaaccgcttcctattgtaaaatacaaagacggagtcgcttacgacaagtttgaagaccctgaactgcgttatcgccaacgttatgttgaccttgctgtgaatgaagagataaaagatatcttcatcaagcgcagtaaagtatatagctctatgcgcgaatatttcaactcaaaaggttatatggaagtggaaaccccgattctgcaatccattgccggcggagcagccgcacgtccattcataactcaccacaacgcactggatatgccgctgtacatgcgtattgccagtgagttgtacctgaaaagactaattgtaggtggtttcgaaggagtgtatgaaataggtaagaacttccgtaacgaaggaatggaccgcacgcacaatcctgaatttacctgcatggaaatatatgttgcctacaaggactataactggatgatggaatttacagaaaaaatgattgaaaaaatctgtctggatgtaaacggcaccactcaagtaaaagtaggcgacaacatcattgacttcaaagccccgtacaaacgtgtcaccatgctggactctatcaaggaacacaccggctatgatctgacaggcatgaacgaagaacagatacgagaagtttgccagaaactcaatatggagattgacgacacaatgggcaaaggcaaactgatcgatgaaatcttcggagaattctgcgaaggtacttacatccagccgactttcatcaccgactatccgaaagaaatgtctccgctgacaaagatacaccgcagcaatccggatttgaccgagcgtttcgagctgatggtgaacggcaaggaactgtgtaatgcatactccgaattgaacgacccgattgaccagttggaacgtttcgaagaacaaatgagactgagcgaaaaaggagatgatgaagctatgattattgacaaagacttcgtccgtgcgctggaatacggtatgccccccacttcgggtatgggaatcggtatggaccgtctgacgatgctgatgaccggacagtctaccattcaggaagtattgttcttcccccagatgcgtcccgaaaagattactccgaaagacactcctgccaaatttatggaactgggaatttcagaagactgggttcctgtcattcagaaagcaggctataacctggtgagcgatatgaaagaagtgaatccgcagaagctgcatatggacatttgcggaatcaacaaaaaatataaattggaactaaccaatcctacggtggacgaagttgccggatggattgcgaaaattgagaattgagaatttaaagattgagaattattccaattgtcaattatccatcataaataataagcatgaaattgcccggtaaaatagcgataatgggtggtggcagctgggccacggctattgcaaaaatagtcttggctcaggctgaatcaatcaactggtatatgcgccgcgacgaccgaattgaagaattcaaacgtttgggacataatccggcttatctgacaagtgtgcgctttgaaataaagaacatcaacttctcttcagatatcaacaagatagtaaaggaatcggataccctaatattcgttaccccctctccctatctgaaaagccacctgaaaaagctgaaaaccaaaataaaggacaagttcattgtcactgctatcaagggtatcgtccctgacgagaacctgattgtttccgattattttcatcaggtatacggtgttcccgaagagaatatagccgtcattgcaggtccgtgccacgcagaagaagtagccttggagcgtctttcctatctgactatcggatgtaaagacattgacaaggcgaagatattcgcccggcagctggccggacattacataaaaacttctgtaagcccggatgtggcaggtatagaatacgcttcggtattgaagaatatttatgctatcgccgctggaatttgcagcggtctgaaatatggcgacaattttcaggctgtattgatttcaaatgccattcaagagatgaaccgcttcctgaataccgtacatcccgtagagcgttctattgatgattccgcttatctgggtgacttgttggttacctcctattccaatttcagccggaaccgcgtattcggaaccatgattggtaaaggttattccgtaaaaagcgcacagatagaaatggaaatgattgccgaaggatactacggaacgaaatgtatcaaggagctaaacaagcacttgcacgtgaacatgcctatcgtagatgccgtttataatattttatatgagcgcatctcgcccatgattgagattaaattattaactgattcattcagataaaatatcagatacaatgaagaatattagtttaaacatcgacaaagtagccggttttgtttctaaggaaacaatcgctgcttacgaacctcaggtgaaagcctgcatggaaacattggaaaacggtacaggtaaaggtaatgacttcttgggttggttgcatttgccatcgtctataacagccgaacatttggctgacttgaaagctactgcccaggttctgcgcgacaactgcgaagtagtagtcgtagcaggtatcggtggaagctatctgggagcacgtgccgtaatagaagctttatccaatagtttccaatggttgaaagcaaaacaagacggacccgtcatcgtttttgcaggccacaatatcggcgaagattacttgttcgagttgactgaatacttgaaggacaaaaagttcggtgtaattaatatttccaagtctggtactactacagaaaccgccttagctttccgtttactgaaaaaacagtgtgaagaccagcttggcaaggaaatggcgaagaaagtgattgttgccgttacagatgccaaaaagggtgccgcacgtgttacagccgacaaggaaggatatcagactttcattatccccgataatgtaggcggtcgtttctctgtccttactccagtaggtttgctgcctatcgcagtggcaggatttgacattgagaaactagtggaaggcgcacgcacgatggaaacaatatgtggtccggctactccgtttgccgaaaatcctgccgctgtttatgctgccacccgcaatgaattgtataaagacggaaagaagattgagattttggtaaacttcaatcccaaactgcactatatgaacgaatggtggaaacaattgtacggtgaatccgaaggtaaggatggcaaaggtatttatccgtctgccgtcgacttctctaccgatctccattctatgggacagtggattcaggaaggtgaacgtactatcttcgaaacagttatctctatcgaaaacccggaacatacgcttcaagttccttcggacagcgaaaatttggatggcttgaatttcttggcaggaaagcgtgtagacgaagtgaacaagatggcagaactaggtactcagctggcacacgttgacggtggtgtacccaatatgcgactgattgtacccgaactgaatgaatactacctgggagaaatcatctatttctttgaaaaagcttgtggtatcagcggttatttgctgggagtaaatccgttcaaccaaccgggcgtggaagcatacaagaaaaatatgtttgctttgttgaataaaccgggatacgaagaagagtctaaagctatccaagctagattataatatcaagaacctattcagaatgccatttatcaatgtcattccgaataacagtgaagaatctgaaagcatccaccaaatgcttgcagattcttcactttattccaatccaacggtcacacctttggaagtaataactatacatttattctatgtttaaagaagcgataaataactatcttcatactcatggatacgaatccatcgacttgaaagccgtattattcgatatggacggcgtgctgttcgactccatgcccaaccatgctgagtcatggcataaaataatgaaacgcttcggtttcggcctcagccgagaagaagcttatatgcacgaagggcgtaccggtgcatctacgatcaatatagtaagtcgtcgggaacgtgggcatgatgctactgaagaagaaataaaagctatctaccaagccaaaactgaagaattcaacaaatgccccaaagcagaacggatgcccggcgcactggaagtattgactaaaataaagagtgaaggactgactccgatggtagtaaccggttcgggacaaacttcgttattggaccgattgaatcataattttccgggcatattccaagccaacttaatggttaccgcctttgatgtgaaatatgggaaaccaaatccggaaccatatctgatggccctaaagaaaggcggctttaaacccaatgaagcgttagtaatagaaaatgcaccactaggtgtacaggcgggagttgcagccggtatttttaccatcgccgtgaatacaggaccattgcacgacaatgtgttactgaatgaaggagcgaatttactttttcattccatgcccgatttcaataaaaattgggaaacactacaatctgcattaaaacaagattaaattttgcaagaattcttcacaatcaataaaaaagagctccttgctttcacctagatgaaaaacaaggagctcatattatataaaaaatcacagcctatcaaaatacctgaacctactttaaaactttgcgtaaccaaggaataaccagttcgtttttaaaataatgagaagggggatctacattgaccgcttcgaaataggtctttgaatccagtccttcatcaaggtgctccacatcttttctaactgccttatcagcaaacttcggataatgatgaaactccgcattttccggttttccactagcagcataagcagattgtaccaaacggaaatcacggtccaaccctccctctgtaaaaatgataggacgaggagctaatgacgcaacaacatctggaaaattaaaatacctccaataaccaggtatcagatgacggatagaatttggaaaaggacgtctgttttccttgtcaggtttagtcattacaacggcacgttcctgagtctggcatagaaaatcattgtacacaaaagcataaatatccttatccaacacccccaagaccatcatcggttctgtacctaatgagaatccgctaatcacaatcctgtcctttcggatataagactgggctttcatccaattcagcacctgcatatccagataagaagtataccctagccaactccatcccagttcaagcaaaaaacgggaaacaacatcatagtcataattccatcctttatcataacattccaaatcggaggcttctccggcagcggcattatccaccgctaccgccacataaccttctttaaccatattcaaagccatacttactttgggattattataatcctcagttaacttatcacagatgccgggctcaccaaccaatccttctttggtccttccggaccccggaatgcacaaaactccgggtactgcacccttcaaatgttccggtttcaaaaccagaaaagtggaaactgactttggaaaaggatagaactcccatttctctaaaatatatccctcttttttttccgttttcacacagacaggagacggttgtctctttatctcgggaaacttcatgatctccaccatcgcagcacgcactccatcctgccattgcgtaaattcctgtgcggacataccggaacggtaagcatattggggatgtgtatctttcaacatctcatgaacaatggcataagtacttagtaaccgtccatccccacgatctgatttcacaactgcatgcttctcaggttggtaattctgagaattaccaaccatacataagctgcatacagatactaaaaagagcaatcttttcattatcatcatattatctcactattattcataccccggagtctgcttgatttccggatctccattcaaaacttccacattaacaggccacaacatcatatacgccttatcctctgttaatataggcaatgaacttccataatgcgctttaacagaaaagacaaaaggttttccgttggaatcacgtaaacgcaataaatcaaaccagcggcttccctcacctacaaactctttatcacgttcctgcaaaatagcccactcattatccgcataatctcctgcaatatatttatgttgttcaaatttatcaccataagcacgcttacgtacctcatttatatatgcagcacatttatccggagctcccaacccgttttcacactcggccagcatcaacaaaacatcagcatatctatataccggtacatctgaatcataataatgagttcctccatccgtatgtcccatcagttttttccaacaagcgccacgagtctttccttcgaacatatattgaaagaaagtagcatccaaacgagtatcttccttatcataaatctcaataaacggcactttatactcataacgtaatggtccggctgtcaatagcttcaacggatccggaccatatttatttccatccaagtccgtagcattggtaaacaaggctacattatagaaccagttcgccccccaattggtcaattcattcttattaaaacacagagcgaaaatgatctctttattcttcttcccttccggagtccataaatccgcaaagtttggaagcagttcgaattgttggttcaccaaattcaataaagccttctttgctgtcaacaagtcactgttattaggatctacggcagtcagagtagctatatgatctcctgcaatatcatcatctggtaatcctgtagtgactttggcagaccacatatatatcttggccttcaaaagttccgttgcatgataagaccattcatattggttggacatcttcttatccgactcattgaagaaagcttcggatttattaatatcttctttgataaactccaacgtttcctccggagtagaacgagccttatataattgcgtaatatcaatgctaccctcggtaactttcggttccgtctctaacggcacaccaccaaatgttcgataaagatagaaatagtaatatgcacgcaagccataagcctgtcccaaataaaatgatttctccgttccagtcagataatcaatttctttatctacatttctgataaacaaatttatatgcatgatatttgggtacacctcataccaatcatcgataccggtattatctttcgtaagcagattattagtcataggcggaccatataccccctcacccatagaagtaacatcacttatcagaatctcacttctgaactctcccaatgtgacaggcatctgatatttatctcttaaatcggcatgaataccagtcataaacatttctacctgagacttctgattccaaaaatcattagagccataataatcttcaggagacaggtccaacgcatcacaagcagacaataccatcatcccactcaacaatatgctataaaatattttcttcataatccttcctatttattagaatgtaacatttaaacccaaaacaactgttctagggaggggatatcctccattctgactgacaccatattcgggggtcgccatatttttggctgctgtaatatatcccaaattctgtgctgttacagaaacatccaccttgctcaaaccggatttatgaatccaactctgaggcaaggaatacgacaggcttatttcacgaaaagccaaataatcgccacgataacaattaatgtccgatattctgtcataattacgtttgcccaaaaagtcagcccatccatacaccggatattttccattcggattactttccgaccaggaatctttaactaaagaaatggtattaaatgttccctgcatattacccataatccaaggagttttccaatcatgtacccaatagcctaaagcataatccaaacggcagttcaaagttaaccctttccatgaagtattaatgttaaagcctccggtccaatgaggtatcgtattacccaatttcacccggtcataatcatcaatcacaccatccccattcacatcctgccatttcacatcaccagcctgtataggcagtcctttctccttttcggcatccgacaatttagcccaagcttcagggccataaagcactttggcatctgctccattttccgtataagtggatctgtctatcagattgcctggaatctcactctcactcttataaataccaagagatttaaaggcgtaaatcacaccatattcctgtccttcctgataaccacctacccattgtctttcataggtaccatctgccagcttgcgtcccgtataaacctgataggcatcctgcatattattcggcaatccattgtacggtaatgagataatcttattcttattataagcggtattcatactaactgtaaatttccaatctttggtacgcaaaacattggcagtcaattccaactccataccttggttttgtacttctccattgttagaaaggaaagaagaaactccgctatgagaaggcagggtgatttctgcaaatttatcctgtgtatgtctattataataggtgaagttcaagatatatttgttattcagaaaaccaatatcgaaacctgtctcgaatgtgtacgatttttcccatctcatggtgggattaggcaaatcgtttatcatcaaaggaactttgccattatagttgggtactattttaccatctttatctttcataataccataagaaccttgaaccgtataataatcaagtcctgtcactacattaccattagcatccagtacaccagacacatttccattggctccgtaactagcacgaattttagcataagaaagtacattgctacaagactccataaaattctctctactcaatacccaaccggctgatataccgggaaaggttccccaacggttatcttttggcagtttggagtatccgtcgcgacgtaaaacaaggctcagcaaatatttggacttataatcataattcactctgccaaagaatgaaagaatacgctgtctgtaatgccaagaatctatttgccgcactccggcagcagtcgaagtataattcaaatcctgaaaatcagataatggagatccataaccagatgccgaaaaacctttcttgtatgagtcataatattctacacctaccatcgcatccatagaatgatcttgccggaatgtagtctgataattcaagattccattgtaagtctggtctaaaagccgttcatgtttgttggaagtactatgattagtatcatacaccggtcctgtagctacaatatagtcccctttgaagaactctctgctatcatcaaaatagaaccaagttcctgtggtcttgaatgtcaatcctttcattatattaaaggtaaaagactggctcagattaaacttgtccgtattattatcataattcaatgcatcctcatacactttcactgtagtccagccacgagcataagaagccacggcagggcctgccaaccaatcaccgtccggacttttcacacggaatgtaggaggaacggacaaggtagtactgaaaaaattaccttcaccggcatatcctgcaccaccatcgtcccattttgcatcggtaaatgtcaaagaagaattagaagtaagccaaggcttaattttataatctgcattgatcgtgaagttcaaacggtgataccagttgttcatcgcatttccttcgctgcgattatagcctaggcttgcataataatgtcctttatcattgccaccggatacgctcaagttataatcctgagtaatagccggagatttgatattataatctttcagttgattatcacaataaatcaatttttgtcccggattcaccgggtcatccattgtctgccaaccttgttttaacaggaaagccaggtcatctgtataattcataacaccccatacggctgtattatccttattaccattaagtacattccctttttcatcaaaatatctgtttcccgttccgtaaggctgtgttccggataaagtcgcatcactggcaaatccatgccaagcacccgatttatcctgccatatatgcgaagaccgataaaatgccgaacgcatataatacaaataatcatgagcattcaaaaattcatactggctatgaaaaaaattgaaaccgactttcgcactcaaatttatttccgtatgtccttccgaacctcttttagtagtaacaagaattacaccattggaagcacgcgcaccataaatagccgtagcaccagcatctttcatgacctccaaagactcgatatcctccggattcacatcactcaacgactcgcgtacagcaccatcgataataaccaaaggtgaaccgctaccatccagattggtaccaccacgaagcaccaaagtaggagtggaattcggattaccgctagtttgctgtacccttaatcctgccactgcaccagagagtgcttgcgccggattagtatgggcccccgtacttaaagtagaattgtcaactttagcaatggaattagtcatcttggaacgaagttgtgtgcccccataacctgttatcaccacttcatccaaagtcttattgtcttcctgcagctgaacattcagaaacgtttttttccctaccaacatttcttgggtcagataaccgatataagaaaagaccaaagacgatttttcacttaccactaacgtaaaccggccgtctatatcagttatggtaccattggtagtacctttctctattatattagccccaataattgcttctcctttggcatcggtcactatacctttgacagtcactttatcttgttgcataacaatgggacgcgtttcttctctagaaatggccttgcgaattattacttgtctgtcacggatatgatattccaaatcagtaccggcaaacatttgtttcagtacctcctctattgttttatttcgtacatccacattgacacgacgagacaaatcaatatctgtacgatatataaaaataaattgactattcttttctacccaattaatcacactcttcaaagtctggttctccatggaaacggtaaagctggtttgttccgcataactcatttccgcaaaagcctcttcataacctgtaaatgttaaaatcatggctaaactcatacattttgtgaatttaggcatgagttttattctattcgtgtattttttcatatatttgattgttttttctatttatttcaaggtaaataattaaacaacgattcagtgaccagatagtacggcaaatactgtctggttttctttttttacatccttcttttattccataggctaaagtattttaaggttcaacaattctcatttaaggctcacatagatttcatctttatcatttattgtataatgcaatgataatgaaagacataagttatccataacattggtaatatctgtttgaagatccagttttcctgacaatgacaaggtcgtaatctctgcatcataccgtattttacacccataataccgctcaagcttctttaaaacatctcctacgggtctttgatgaagcagcaataaattatccttccaactgatgtattcggacacatcaaccttacgtacctgcgttttattgcctttaatatccaccaattgattaggtgctaatcttactttgctcttattctcagtagttacttccacgcttccacgtactaaaacaacagatgcagcctcatcctccctataggcacagacattaaacgaagtacccagcacgcgtatatcaaactctcttgttttgacaacaaatgggcaatccttccttttggctacatccagataaacctccccctctaccaagatttcacgtttccgttcttcaaaaatatccggatatatcactttactacctgaatttatataaattctagtaccatcagaaaaagtaatatcagctcttttcccattaggaaccattatttgatgcatttcattctttacagatgaagcctgggatattttagtatttaatgcatactgctgaatattcgaacttcctaaagtatcatattttaaagaagcatcatttttcagattcatagcttggttatctgttatcagaatcacctcatcaccgcaaatggaagtcgtgtcattcagcaatgctatatcaagctccgtaccctcatcaacattggtactccaccagttcataactaaagccaaagcaatcgctgccgctatcgacaaagaccacctataaatatgacgtctgtggggaacctttttttcccttcctactcgtttcatcacgtcctgaaaagatttgtctacatcaacagattccagttcatctgcttcccgaatcttctcagtcaggcattgaactgttttacgaaattcatctgaattatatattgtttttttatttttcatcgaaaaacctttttattaagaaaacggtgcccgataaaaaaggtactcataaaaaagaaaagaaatcacacttttctttgcatgagccttcgcaaaaccaatagacaaaccttatatgacaaataaaagaacttattcatcacacaaatatcacttcattccatgaaaacatgcccaaatgataaaacaacaatgattgactactcgctaaatcaagagaagtgaaaagcccaaacactacgcacaggcacatgaacacaatgcaccaagatactgaaaatccatatggttgaaacagagaaaaagaattcacgcaaacgtgccaatgtacgcgacaaaagattcttgcttgattgaggattcatacctaagatagcggatatttcctgatggctcaattcttttacataatataaatacagaatttcacgctgacgaccggaaagacgtgaaattgccttagccagccttctttcattcttcacatccacatcatctttcttaaataaagaatttattatttcttcgcccatcggaaaaaattcatggcattcttcaatcacttccataggacgtaaagactgaaacgcatccagcagtttatttctaaaagaacaaagcaaatacgcttttacattatcagtataatgcaaattcctacaatttaagatcaacttgacgaacagattctgtatggtatcagcaaccagctctctgtcacctaccatacgaattccataggaatacaataacgaataatagcgtcgataaacttcttcaaatgccgccgtttctcctttaatgaaagattcccaaagtttagtttcaccatgtgttctatcaaccataatactagctccttaacttattaagcttgctcagagttaaacttaacaagaagacaatataagagatgaatcatgtaatggactcatcccttattttataatacctacatatttattcaaacagtttactgcgcgacaacatacaagcaccgatgatcccggctctttctttcaatttagattctacaataacagaatcacggttcatcaagttcagtgtatattttcgaatagctgtagtgatgggttgtgtcaaataatcacctgtacgtgacaatgcaccaccaataatgactagctccggattaaatatattaataagtcccgctacatggcgacctaatttcactccgatttcttccaccagttcaatacacagcaaatcttccttatttaccgcatcaatgatatcatccaaggtcaaatcttccaaatttttcttggtattggagataatagagttttcaccattattaatatgttccaacagaatacgatgcaaagcagcccccgaaacttccgtttctatgcatccttttttcccacaatggcagataatctcattctcatatccaaaattatgcccgaattcgccagagaaaccggattttcctttataaatctttccatcaatgataattcccatacccaatccccaactgacattgataaagatgatattcttctcacctttcacaacaccttgcatatactcaccgtaaatcatagcacgagtgtcgttatcaatagagacacgataaccacccaccttttctgatatgacatccgtcaacgggcgctcatcaaaattgaatatactgtaactatatcccaaatccggattcacacgcccggaaagatttacattaatatttaatatcttatctttctcaacactgactttttgaagaaaatgtttaatcaacttacacaattcgtctaaactctcaggggtattcttcgctttaaaaggaacattcatttttagctgaactacatctcctttaaaatttatcaaccctaagttaatggaaaactgacgcacttcaacacctacaaaatatccggaatctgcattcaaaccatacaaactgggatgtcttcccccactggtttccagctttccatagtcgttaatgtaaccttcctcacacatttcatcaatgaattttgtaactgtaggcacacttaaatccatctctcttgctaaatcagtaatcgtagagcttccattataaatataatgggtaatgattttcttcttcatcacagccatctttgagcccttttcaatttctttcaacaaattctcacccataataaaatattccgttaatgtccacaaatatagttatttttttatgaaatcaaatcacatttaaagagaattttcaaaaattattttagaagatgtaagctaattatcattttttgtaacaattccattttccatatacatttaaagaacgtttctaagtcgcttatttatctttctatttattaaaagagcgattattaataaataaatttagttttcacttgttgttttcataaatcatttatatatttgcacgcaacatgattaagtaatataaaatattcatttcaaataaattaaaggctatggaaaagattcacggattaattgacgcaccttttactcccttttatgagaacggagaagtaaattatgaaccgattgaagcctattgccaactattggttagaaacggacttcaaggcgtatttatcaatggttcttccggagagggctatatgctgacagaagacgaacgcatgaaactggctgaacgttggatggaagtagcacccgaaggattcaaagtcattgtccatgtaggaagcacttgtgtaaaatcaagcaaacgtctggcagaacacgctcagaaaatcggagcatggggtatcggagcaatggcacctcctttccccaaagtaggacgcattgaagaattggtgaaatactgcgaagaaatagcatgcggcgctcctgcacttcctttctatttttatcatatcccagctttcaacggagcattcctctcaatggtagcattcttggaagccgtagacggtcgcattcctaatttcgccggtatcaaatatactttcgaaagcctgtatgaatacaaccaatgccgtttatataaaaatggcaaatttgacatgttgcacggccaggatgaaacgatccttccttgtctggctatgggcggtgcacagggcggtatcggtggaacaaccaactataacggcaaagaactcacaggtattatcgaagcatggaaagccggtgatctggaactggcacgcgaacgccagaatttcgcacaggaagttatcaatgtcatctgtcactatcgtggaaacatcgttggcggtaaacgcatcatgaaactgatcgggctggatttaggaaagaaccggactccgttccagaacatgacagatgaggaagaagctgccatgaaagccgaactggaagcaatcaatttcttcgaaagatgtaacaaataaacctgaaccacgatgttttcaatagactatataaaagaatggtcggaatcatacaaaacagatctgaccaccaatatcatgccgttttggctgaaatacgggctggacaaggtcaatggaggtatttatacctgcgttgaccgaaacggcagcttgatggacaccaccaaatcagtgtggttccaaggaagatttgcttttatctgttcctatgcatataataatatagaaaagaacgaagcatggctggcggcagctaaaagtacaatagactttatagaagcgcattgttttgactctgacggacgtatgtatttcgaagtgactgccgaaggcactcccttgcgcaaacgccgttatattttctcggagtcattcgcagccatcgccatgtcggaatatgccatcgcatccggtgaccagacgtatgccgtaaaagcattagacttgttcaaacggatgcagtattttatggaaacaccaggcatactccctccaaaatatctggatactcttcctatgaaaggacattccatcacaatgatcctgattaatgtagcatcacgtatccgtcaggccattcaagatgaaagcttcaacggacagattgacgcttccatcgcccaactgcgcaaagatttcatgcatcccgaattcaaggcgttgcttgaaacggtaggtccccatggagaattcatcgacagcaacatgggccgcaccatcaatccgggacattgtatcgagacagcctggtttctgctggaagaagccaaataccgtaattgggacaaagatattacggaattggccctcactatccttgattggtcttgggagtggggatgggacaaagaattcggaggtatcatcaacttcaaagactgcaagaaccttccgccacaggattattcccaagacatgaaattctggtggcctcagacagaggctatcatcgctactttgtatgcatatttagcaaccggaaatgaaaaataccttgacatgcacaagcaaatcagcgattggacatacacccatttccctgataaagagtgtggagaatggtttggatatctccatcgtgacggcacgcctgcacaaatggccaagggtaacctgttcaaaggcccgttccacattccaagaatgatgatcaagggctatacattatgcgaggaaatactcgacagcaaaaaatcacatttataaagccctttatctattagcatgaaaaacagtaaaatttatccttgggttgtagtaggattattatggggtgtcgccctgttgaattacatggaccggcaaatgttgtccacaatgagagatgccatggcggtggatatcaccgagcttcagtcagctgccaattttgggcgactgatgggagtctttctttggatatatggctgtatgagccctatagccggaatggtgggcgaccgcatgaaccgcaaatggcttattgttggcagtttgtttgtatggtcggccgtcacttatctgatgggaatcgccgacacctataatgaagtttttttccttcgcgccttgatgggaatcagcgaagcgctctatattcctgccggattgtcactgatcgccgactatcactccgataagtcacgttcattagccatcggtattcacatgaccgggctctacaccgggcaggccatcggaggtttcggcgctacagtagccgctgctttttcctggcatacaacctttcattggttcggcatcgccggcatcgcatacgccgtaattttgatgctttttctacatgaaaagaaggatagaatacaaattgaacaaataaattcaccttccggtaaagaaaaaagcaatttattgaagggattatcattacttttcagtaatattgcattctgggtgattctgctatatttcgcagcccccagtttaccgggatgggcaaccaaaaactggttacctaccttgttcgccgagaacctgaatataccgatgtcacaagccggccccatgtcgactatcaccatcgcgctatcctcgttcattggcgtaattattggtggaaccttatccgataagtgggtgcaaagaaatataaaaggacgtgtgtacacgggtgccatcggcttgggacttactattccatccctgcttttactagggttcggacacagtttcgtagctgttgtgggagctggattattattcggaatcggttatggtatcttcgatgccaacaatatgccgattctatgccagttcgtatcatccaaacaccgtgctaccgcctatggtatcatgaatatgacaggcgtgtttgcgggagcagccattaccgaagtcttgggaaagtggacagacggaggtaagttgggactgggatttgccatgttggctattattgtgcttatcgcactggtagtacaattgacattcctccgtcccaaaacggataatatggaataacccgtatagttaacttaacacttaaaacttaaaaaagaaagaaccatgagagtaattattgaatctgattaccaagcgctgtcacaatgggcggcaaactatgtagctagtaaaatcaatgcggcaaatccgactcctgaaaaaccttttgttttaggttgtcccacaggatcttcaccgctaggcatgtacaaagcgctgatagaactgaacaagcagggaaaagtatctttccagaatgtcgttactttcaatatggacgaatatgtaggcttgcctgaagatcatccagaaagctaccatacatttatgtggaaaaacttttttaaccatattgatataaagaaagaaaatgtacatatcctgaatggaaatgccgaagacctggaagcagaatgcgccaactacgaaaaacaaatagccgaaatcggaggcatcgacctgtttatgggaggtatcggtcccgacggacatatcgcattcaacgagccgggctcatctttgtcttcacgcacacgtatcaaaacactgactacagacacaatcattgcaaactcacgtttctttgacaatgacgtgaacaaagtacctaaaactgcgttaacagtaggtgtagggactgtcctttcagccaaagaagttctgattatctgcaacgggcacaacaaagcacgtgctttgcaacatgccgttgaaggtggtattacacaaatgtggactatcagtgcattacaaatgcaccagcatggcattattgtttgtgacgaagccgctacagacgaactgaaagtcggtacctacaaatatttcaaagacatcgaaaaagctaatttgtaatttatgagaacaaacttaagttcgcagatttctctgaacagagtatctccgaaatattataaacccgaaaatgcggtggaacgttctgtcttgacccgctgcgaaaaagtgcctaccgacatctatgaaacgatggaggaaggcgtgcagcacattgccaacgaaattacggcaaaaatccaggaacgtcagcgcgaaggaaagttctgcgtgattggggctggaaccggtgcttcattacggccgctttatgccgaactagtccgtaaacataaagatgaaggactaagtttccgtaacgtagtaattttcaatttatatgaatattaccctttggcttccgaaggggctggaagcagtttctcacagctgaacgacttattcctaagccaaatcgacatcgataaacaaaatgtattcaccatcgacggaacgattccgcaggaagctgtcatcgaatactgccgcctgtacgaacaacgtatccagacttttggcggtatagacatcgtattaatgggcattggtcgtgaaggcaatattgccatgaacgagccgggatcaagcttgagctcccctacccgactgattttgattgactcaacctcgcgtgctgaagctgcacacaacttgggagtggacaatctccctccctgttccatcacgatgggtgtggcaactattatggctgcccgcaaaatctatttgctggcatggggagatgacaaagccgatatcatcaagaaagcggtggaagacaaagtgagcgacactctgcccgcttcttatctgcaaatgcataacaatgcaaatgtctgcatagatctggcagcggcttctcaccttacccgtatccaacgtccgtggctggtaaccaattgcgaatggaacgacaaattgattcgcagcgctattgtatggttgtgtatgcgtgtcaaaaaaccgattctgaaactgaccaacaaagattacaatgaaaacggactgagcgaactgctggcactctacggttctgcttacaacgtaaatatcaaaatattcaatgacttgcagcacaccatcaccggatggcccggcggcaagcccaatgcagatgacacctatcgccccgaacgggcaaaaccattcccgaaacgcgtggtagtcttctctccgcacccggatgatgacgtaatctcaatgggtggaactttacggcgtttggttcagcaaggtcacgaagtacacgtagcatacgaaacttccggaaacattgccgtaggcgatgaagaagtagtacgtttcatgcacttcatcaacggtttcaaccaactttttgatgaaaactccaacgaaaccatcaaaaacaaatacgctgaaatcaagaaattccttgccgccaagaaagaaggcgatatggacagccgcgatatcctgaccattaaaggactgatccgtcgtggcgaagcccgtactgcaagtacttacaatcaaattccattgaaccgtgtccacttcctcgacttgccgttctatgaaacaggaaaaatcgagaagaaccctatcagtgaagccgatgtggaaatcgttttacagttactacgtgacgtaaaaccccaccaaatttatgtggccggtgaccttgccgacccgcacggaacccatcgtgtctgcacagacgcagtgcttgccgctatcgacatcgaaaaagaagccggtgccgaatggttgaaagattgccgcatctggatgtatcgtggcgcatgggcggaatgggaaattgaaaacattgaaatggccgtaccgttcagtccggaagaattgcgtgctaaacgtaactccatcttaaagcatcagtctcagatggaaagcgcaccgttcctgggcaacgacgaacgtctgttctggcaaagaagtgaagaccgcaaccggggtaccgctgctttgtatgaccaacttggtttggcatgttatgaagcaatggaggccttcgtggaatacgtacccctataatttaagaaacaacctaacctaattttatactaacctttaaccaaaaaaccgaaaatccccgacggatgtgatatccctcggggattatttttagatttccatttattgcaaatgatatcccatagtcatcctcaccacagctacctgcttcgaacaacacaccccaaactacatctcataattcattaatcccatagccaaacaaagcaaaatcccccagacaaggatcttcgggaaaaacctcagccaaagccgcagtaatagttcttgcgttattcagcgtataagatttacttcgggtcagccccaatctgaaagccatctcactgacatgtgtatccaaagggataatcaactcacatggagagaaattcctccagattccaaaatccacttccgaatcgcgacggatcatccagcgcagaaacatattcaatttcttttgcggcgccttatccgacactccaaacaaacgacaaagacgttgcatcggagttccatccgtttcgcaaagaagagcattctccatactctcatacctatcatatatagtatacagccaatgaaacaattgtgccattctattttttgaaaccgtccgatagaacgactcctcaccacagaaatcagttttccagttcccggacaacacatactgcaaaggctgccggtccattatggaatccagccgttctgccgccttcagtatttgagggcgggctccgaaactaagaaaagcagtcagaaaagcactgatttcaatatccgctttgaaatgatagcgatgcgggaactgtaccggatcagaagaaataaaatcagagttatgataccggtcagcatatttccgcaaaaaatcagccaccgccatccggctctcatgagtttgccgttctgtaatataagacatgaatcgctcttgttcgttctttcgggtcataaataaaacgtttatgatttgtacacaaaggtatattaaaataaaatagattgcattttcagaaatcaaattccatccttaatcctcaacctgccttttctatattctttaggtgaaatccccacatattgcttaaaatactttccaaagaaagactgcgtagggaaattcaattggtctgcaatctccttgatactcagatccgatccttcaagcaactgttttgcctcggtaatcaccatttgcacaatccattgcaaagcactatttcccgacttctctttaatgatggtggaaaaataacgtggagtaatatgctgcatcctcgcataataagcaacatcacgctcctttctatacaaacggaaaagagccagcatgaaattctgaaaaatcacatccttcttgttctgcggcaagggctgcatgggttggttggcaaaatacatattcaatatctcatagcagaaagtctgccccatcgacttgatcagttccaaagtcaggcgttgttgctgcaaattcacctcttgcacatcctccgcctctatcctctcccgcaaattatccaacagatactccaaatgagcacgttgcttatccgaaagtgatatacaaggatgcttccgcataaaaagctggttttccacattgatcaccctattgacgataggaatgatataatctaaatccacttcaaccataaccccttccgcatcctcactcttatgaagcagatgcaccaaggtagaagccatgtaaatatacacatcaccgggatttatctgaaaatgcttatcttccagtgaaacctccacatttcctttccggcaaaagaaaaggccacatttattaaatgtcgaaataatctgtccgtctttaaaagtatgcggatcactgcttgaaagcaatgtaaactgaaaaggcatttgtcgtctgaacatcaatctatgtcttttattaattcactgcaaaataaatacaaatcgcaaacttttaagctatatatccacaagaaaatatacaaatcggacaatttatcattcatatcaaccttttctatcctcttgcttcgagataactttgcaccagaaaactaattgcacgaaaatcatagtagtatgaaacgaatttatcttattctaacaggtatttccttgatcttactaagttcctgcgcacaacgtgcccgggaagccaaaggtcatcagacagtaaaaatagacacagttgtttctgccgacaaacaaacgttcctgcaatttccgggaaaggtaaaagccgcacaagatatcagccttgccttccgggtaagcggaaccatcagcaaaatacatgtcaaagacggcgcccgtgtacaagaaggacaattactggccgaactggaccccaccgactatcaagtacaactggatgctactgaagcagaataccagcaaataaaagcggaagcagaaagggtcatggctctttacaaagacaacggaaccacccccaacgccaatgacaaagccgtatacgggctcaagcaaatcaccgccaagtacaaacaccataaagatcagttggcttacacccggctctatgctcctttcaacgggtatgtccagaaacgcctgttcgaagctcacgaaaccatcggagccggaatgcccgtcattgccatgatcagcggcggaacccccgaagtggaaataaatctgcctgcggccgaatatatcagccgggagcagttcgacaattatcactgcacatttgatatctatccgggcgaaacctacccgctgaaactaatcagtgtcaccccgaaagccaacgcaaaccaactatacaccatgcgcctgcaagtagtacccggcacacgggctatcccttctcccggcatgaacaccatggtaaccatcctttgccgtacagagcaggagaatactctttctgtccctaccggcgccatcctgcaaaaagaaggcaaagcgtatgtgttcgtctttcatccatccagcaataccgtacacagacaggaagtatccatactgcgtttgttgaacaacggacacagtctcatcacttccagacaactgcaaccgggagagcagattgtatcctcgggcgtacaccacattgaggatggagaaattgtaaaacctttgtcaccggtcactaacacaaatataggaggattattataatggacatcagtaaatgggcattccggaacaggaatctgatttatttcctgatagcggttctgctgctcggcggagcctattcctgctatcagatgagcaaattggaagaccccgaaataaaagtgaagcttgccatggtagtcaccacctatccgggtgcttccgcgcaccaggtagaactggaagtaacggatgtgcttgaaaagaacatccgcaccatgggcaacattgacaatatagaaagttattcatacaacgacctgtccctgatacagatagaactgctgagcaccgtgccggacgatgacgtggaacaatgctgggacatgctgcgccgcaaagtaagcgacgcccgcgccctgttgcccgaaggagccaccaccccgatagtcaaagatgacttcggaaatgtatatggcatgttctatgccctgacaggtgacggactgtccgaccgtgaactgtccgactatgccgaactggtaaaacgggaagtgaacgaactggaaggggtagaccgtgtggaactctacggcaaacgttccgaatgcatcaatatctccctgttgcaagaccgtatggcaaacctcggtgttaaacctgcagaagtactggcaaccttgaacggccagaacaaaaccacctatacaggatattatgaaaatggtgaaaaccgtatccgcgtcacagtaaacgacaaattcaaaaccgtagaagatatcggaaaaatgctgattcaaggacacgatgacgaccagcttcgcctgagtgacatcgcccgtatagagaaagcctacgagaaccccacacgcaatgaaatgttctatgaccatgaacgcgctctcggtatactcatcgctgcctccagtggttcggacattataaaagtaggccatgccgtagaaagcaagttggaagaactcaaagccgaacgtctgcccgcaggagtggaatgccacaaaatcttctatcagcccgaacgggtaggcagctctttgggaacctttgtcatcaacctgatagaatccgtcatcatcgtagtactgatactgatgatagcaatggggttcaagagcggccttatcataggtatcagcctggtcatcaccgtattcggttcttttctgttcctttattcggcaggcggaaccatgcagcgcgtatcattggctgcttttgtactggcaatgggaatgttggtagacaacgccatcgtcatcatagacggcatactggtagacttgaaagccggcaaaaaccggatggaagccatgaccgccatcggaagacagacagccatgcctcttctgggcgcgacactgatagccatcatcgcctttctacccatctacatgtcccccgacaccgcaggcgtctacacgcgcgaccttttcatcgtacttgccgtttccctgttactgagctggatattggcactgatccatgtaccactgatggccgaccgccggctgcatcctgccatagatactgacagtaccggaaagcgagtatacaaaggtaaaatctatgccaccctccgttcggcactgcggttcggtctggcccaccggtggagttttgtatttgccatgaccggtctgttgctgctttccgttttcggctaccaatatatgcgtcagggctttttccccgacatggtttacgaccagctttatatggaatacaaacttccggaagggaataactatacacgtgtggttcgagatttggaagaaatagaaacctatctgaaaggatgggaggaaataacccacgtcactacctccataggcggtacgcccggacgctataatctggtacggagcattgccaacccctcactttcgtacggcgaactgattatcgacttcacctcaccggaaaccttggtagaacatatagacgaaatccaagcttacctctcccaagcctatccggacgcatacatcaaattgaaaagatataatctgatgttcaagaaatatcccatagaggcgcaatttctgggtcccgatcctgccatcctgcaccaactggccgacagcgcccgcgccatcatggaaaggactccggaagtctgcctcatcaccaccgactgggaacctcaagtacccgtactgaccatcgaatacgaccagccgtccgcccgtgccctcggcctgagccgtaatgatgtcagcctttccctgctcacagccaccggaggcattcctatcggctctttctacgaaggtatccacaaaaacaacatctacctgaaatgcctcgacgagaaaggagaaccgatagaggacctgggcaacgcacaagtcttctcgtctctgccttccctgaacggactgttgaacgaggaaaccatggtgaagctgaaagccggcacactttcgaaagaagatttggtggaaagcatcatgggaagcacaccgctgaaacaaatcagcaaagagattgatatccggtgggaagatccggtagttccccgttacaacgggcagagaagccagcgggcacaatgttcgcccgcacccggcattgaaacggaaaaagcacgtcttgccatcgcggaacagatagaaaacataccattacccgaaggttattcactggtatggcaaggagaaaaaatagccagcgaccagtccatgaagtatctgttccaaaatttcccgttagccatcattctgatgattgccatcctcatcatgctgttcaaagattatcgcaaacccatcatcatcttctgctgtattccgatgatatttgtaggggtggtagcggtcatgctgctcacaggaaaagtcttcaatttcgtggctattgtaggcacattgggattgatcggcatgctgattaaaaacggtattgtgctgatggatgaaatcacccttcagatcaatgaaggagtagaaccgatcaccgcactgatagacagttcccaaagccgtctccgcccggtcatgatggcctcgctgacaacgattctgggtatgattcccttgctgtccgatgccatgttcggttccttggcggcagctatcatgggtggattgctgtgcagcacactgatcacgctgctctttatccctatattatatgccttgttcttcaagataaaaaacaattgattcatttcactgacatacaaaaccgagaataaatgaaaaagacaatgatactccccctctgctgtctgctgtggcatcttgccacccccgcatgggcacaggaaacactgagtctgaaagagtgccgcgaaatggcattaaaatacaacaaggaaatggcggcttccgtgaaacagacggaaagtgcccgttatactgccaagagttacaaagggaacttcttccccaacttcaccgtcagcggaacaggactttacagtaatgccgacggtagttacggcatagccggaggcaacctgcccgtctttctgcccgatggaacaggacagttcaatccgggacaacccgcaggctttgcctacttccccggcattaacctggactataaaataggatgggtctatatgggcggtgtgcaaatggaacagcccctctacatgggcggtaaaatccgtgccgcctacaaaatgtccttgctgggcaaagaaatggcacaaatgaatgaaaatctgaccgcaacagaagtcattcagaaaacagatcaggcatacgctctggtagtaaaagcaaaggagatgaaaacagtagccgatgcataccacgctgtattgacggaattaaaaaataacgtagagagtgcttacaaacatggacttaaacctcagaatgatgtattgaaagtacaagtaaagctgaatgaaagcgagctaggtatccgaaaagccgagaatgctctccgcctggctaccatgaacctctgccacctgatagggaaaccactgaccacacaagttcatgtttccggagatttcccggagatagagaaagacctggaagtacaggtactggatatcacccgccgtccggaatacggaatactggacaaacaagtggcgatagcccgccagcaggtgaaactgaaccgcagtgaactgcttcccaaagtagggatcaaaggctcatacgactatgtacatggtttggaactgaacaacaagaatttcctggacgatgccagtttctctgtccttctgaatgtaagcatccccttgttccatttcggagaacgcagcaacaaagtacgtgcagccaaagccaaactggaacaaacccgccttcaacagcaaaacctgaacgaacaaatgttactggaactgacccaagccgccaacaatctggacgaagcaaagctggaaagcgaacttgccgaccgttccctgcaacaggcggaagagaacaggcgtgtcagcaaaagccagtacgaagtaggtctggaaacactctccgaccatttggaagcccaagcgttatggcaacaggcttacgaaacgaaagttgacgcccgtttccaactttatctgaactacgtggcctatctgaaagcagcagggaccttgcatgacaagctgtaagtctcttgttccggattcagattgagtacaaatacaagcaatccctccttctccggagttttataaatgtgctgccactgctaccacccactctactggaaccaccatgaacaaggcgtttcaacgggtggtggtagcacatttttttatgggtaaaaagtgctgccaccaccactttccctctctttttattcccaaacggataaaaaaggggctatacttcggctataccttcctgcttgcgcagcacatacaccgcatgagaatgctttccttctttgtccaatctcttctcctcataccaagccttcagctcgtaggccgccgtagtgcgcgccacccccaaccattccgaataggccagacgtgtaatggaaccgtgttctttcagataagcctccagcaacgtccaacgctcctccttgctacgctttttcaccgtaggcaagaagccgaactcggcacggaggatgtctgtttcctgccgcacccgcttcaccagttccggcaccggacggaagttcaccttctttatcctcacggatgccgcacgtatctccttccggtctgtcacctcacgcgaggacaaggcaagagaaaacgtacccaggccgtccagccgcacattttttccttgccgcaaatgggatacaaccatatcggccacctcctgtagcactcccaccacacagcccgccgaatatgcgctatgcttggacaactccttcactatgtgatcggtagtaatcgtttccttcaccactaccgccggataaagcaccggtttgccgtccttttccttgaaagggttggccttgaaatcatattttatatccatcattaaaagatttgatctgtatccgcaagccctttctgctctatggttaagggttctcttccttttgtattctatctccataagctttggacttgactccaaaggctatggagttatctccaaaggttatggagtcaactccgcaacctatggagatagaacacatctggacaaagatacttaatctttaggggaaaaaggcttaatataaaggaaaagatggattaaggagaaaaataatcaggtagtcgaccctttcttaaaaaactaaatgaataaacaaaaggatacgcgatatacagggagataccctgataaaaagattgggtatctgcggagaacaacggtttcattgtattctgcggacagacagaacggtttataaccaaacatcaaaggaaatatatttgatgcaaaagaaagaatatcatttttttatcctatttttgtgttggcaacaaactaataccataatacacagactgatgaaaaccactattttacttggcttattattgacccttacggtttcatgcaaacaccattccaaccccgtaactaccgaagaaaacttccacacccaagaagccaaccgtctggtagcagaagcgaggaacctatggttgcctcctttagacagcactttcttctttaatgacagtgaacatatatctataaacgacaaggaaatatgggccaaacttgacagtgcattagccattgaccctaccaatataaaagtatatgtgggaagaatcagttatttatcagcctgcaaaaagtaccatgagattctgtctgtactccggcaagctgaaaaacaatccaccctcaatgccgacttatggtcaatgaaagcgatgtttgaagattatttcggagacagccttaccgcccaaaaaaattatcggtctgccgattccgcctatgccatcctcataaaagaatatgctacagacagcctcaggtatgccggttcccgcatcaaccgcgcactgaacatggcattgatgactgataatattgcgattcttgaagaagaggtggaactcactaaaaagatatttcccaagacatggaaaggaccggacagtagtttttacgggaaaaataaaaaagactttttcgacaaatgctttaacgtccgcaaaaagtaatccagcctgctacatcaagaaaattacaaatcattgcatttgaaagaacagacctgtaatacctactttcaatacaaagactttttagcacaaaggtgtaactttctcttcttttcaccgactaacctaataaaaacacctttgaaagctgatgagtatagaacaggaatttgccgacaagctagtgcaatacaagcacatcatttacaaggtatgcttcatgtatgcagacaacaaggacgatgtgaacgacctttttcaagagtctgtattcaatatatggaagtcatacaaaaacttccggggggaaagttcgtttgtcacatgggtttaccgcatatccctgaacacgtgtatctcggacttccgaaagaaaaagaagtatgactatgtacctttggaacagcaggtagatattctggaagattgtgaacacaacgaactgctgaaagaaatgtattcactcatcaaacgactgaacaaggtggaccgtatgtttatcctgctctggctggacgagaaatcatacgatgaaatagccgaaatcaccggaacgaaccgcaataatgtcgcgataaaactgcaccgtataaaagagaaattaaaaaatatgtcgaacttgtaatcatacaattatatggaacttgaagaattgcaaaaagcatggaaagagttgaatgaacgggtcagccagaatgaactggttcatcagcaacagattatagagatgttgtcacggcaaaaagaaagttgcctgcaaagaatgctgaggatggacaaaatagcttctatatttatgttaggagtaacgattctaatgttcgttgattttattcatttgaacggtaaattagtgttttggccggcaatattcggacttctgctatatgctcttacagtcaactttgcaggagttattttattgactaaaataaaaaaagaaacaaaccttgaaatgcaaataaagaatatactccgatataaaatgcttatcaattggagttatatcatcggatatttgctggtaactccttttatatgcatattcctttacacctaccgccacctgtggtggctcatgataacaatgtttggtttaatcttagcaggtgtactgacagactacttcctcttccatcatgtatcggacagaattaaagaattgacacacgtcaataaagaattgatggaactgaaaaagaagcataaagaataaattttcactctacagtgagggtacttatccggatattttattcctttgtaccctcaatcagaataaaaagcactttatgtttcaactgtatctgctgcttcgtctgaaaaattttggaagaatagttatagaattgggtatcttcagaatagtcttccttaccatcttaacggtggctgccatcatgatattgttcttggcagaaaaccgtttcgctattcctgtggtatgcgttctcttattagccggttatcataatgtccggaaagacaaagagtttttacgcactttaacacctcatctttctgtgttcttgataaaagaatacaccttgatcgcattaccttttgccggaatagaaataataaaaggacaatttaccgacgctatcggcttatggctgttcgccgccttattaccttgcctgaaaaaaataaaactgaaacacaaacctgtccgtcttccttttctttacaaaggaagttatgaatatatacgaatattccgccaatctttctgggtctatatcctactctttctttttgcaaccgcaggaaccgtacacggaaatataaaaataaacaaagtatgtctcatactatggggattggtacaggcatcaggctatctgcaaacaatggacaacagatatcttcttcatttcaaaaatttcaagactttatgccttttccaactaaaaagcatagcatggaatgttttcatcacctccattcctttcagcttaacgcttatagcgtctacctatgaccaagatgaaatcctctttttcttatcttattatactgccaccttaatttatgccattggtatcggtatgttgcaccatatcatcccatcccccctattgctgtttattgtgcaattaagtatattaatgcctttttatttaggctctctttttgttccaattattttaatacccggcatagcacttacagcattgctgacctgccatgcgcacaaacgcttaaaaagattattatgatagaagtgaatgatttacataaaagtttcggtaaggtcaaagtattaaacggcattcatttggagtatcaccctggaaaaatatatggcttggtgggcgagaatggagccggaaagactactttattcaattgtataatgggaatctatgattataccggaagcataaccaaaagcaaaactttaaaaacaggttatctgtctgcatccaacttcttttattcccaaatcacgggtcttgaacacttggaattctgtatgaaggccaaaggtctgccggtcaatacacccaccattcaacatttaaatgaaattttccaactgccccttgacaggtatgctgccgaatattctaccggaatgaaaaagaaactgggatttatggcattattgttgcaagacaatgacgtatttattcttgacgagccgttcaatggggtggacttgaagggatgtatcctgatgaaaagactcatccggcaactgaaagcaaaagaaaagacggtgataatttcctcacatctcattgcctcgctaagggaaatatgtgatattatccactatctgaacgaagggggtatttacaaagaataccatgaagaaacaacagaagagatagaagaggatatattatgcaatactaaaagctgattcatctatcatgatgaaacaaatataacagtggttttaccactgaactaccatgaaaaaatagaatgaaaacctaaagaaatatttgttcataatgcattgtttttataattaaagaaaatctcctttcaccataacaaattgtaaatcaatagaattataatccgtttggtgtgaaaggagattttataaagtcctgtttccgttcttattcagccggttcttacaaagtacaagttccttcgaccagcttgcccattgcccatacggcacggatattcaagtcctggtcaagaatcaagatatcggcatctttgcctttctgaagtgagcccttgcggtcatatactcccataatcctggacggagtttccgaagccatacggacagcatcttccaatgggatttctgccttttgcaccaaggtacggatcaaacggtccatggtagccacactgcctgccaaagcagaacggtcggccagtttgcacacaccatcctcaatgatgacacgagggtcaaaagctacattgctttcactggcggcacatgccaaagcatcggtaataacacaagcacgttccacacccttaatcttatatatcaggcgcaagatagtaggaggaacatgaataccatcggctaccacttccactgtcatatcgtctatcagatagatactttctactgtaccttcatatttatactcacggcgcttatggaagcccggcatcgcattatagaaatgtgtagcatgagaataaccggactcccaggctgcacggatatcttcatattcggcctgtgtatgtgccacagaagccaagatgccttttcctgtgatatacttaccaaactgcatggcacccggcaattcgggtgcagcatcccaacgcttgatacagccccacttctctacaataggaatatattccttcggatccgggtcttttatgttttcaggcatctgaccgcctgccatcttcatattaaggtaatgcccttcaagatgaagaccaagtaccggactgtccggttccgccatcaacctggtacaagtttcggcagctgcctcaatcatcggtacggtagaagaagacaacgttgggaaaatactggtagtaccatgtttcatgtgagcattaatggctgtacggaaagcctcttccgtaccttccataaaatcaccgccaccaccaccatgacaatggatttccacaccaccgggaacaacatacatacctttagcgtcaatcagctcggctccgataacagctaaatcacaattggtaacttctaaaatcttattgtcgcgcataaggacagatccgtccttcaaccagccctgtggggtaagaatctttgcgttaatgatttgggtcaacatgatactatgataagttagaatttttaattggcatattaaatttgccaacaaaaatagcaactttttcactttctaaaacagatttccccaattattttccaactttttttaataaataagccccgcttaataaaatcaagcggggcacagatagtggaaattgaaacaaatctttttacttactcattaaaactagcctacctgatttaagtcctttacctgttgcggtcaatatgatttctcccggtttatcagtactttgcacaacagcagtcatcattccgttaaacactttcatctgcggaacatggaaaagttccaatgaagtgggatctccgtttgcaccggcacgataggttcccgcaccttttacagaatacttgatgagatgctgcgcatcgggacaaagattaccctctttgtccaccactcttactgtgacaaatgacaaatccttgccatcagcctttatttcattgcgatctgtaaccagttctatatggtcgggcttgcctgccgtatggatttccttttcggccacagcttcccccttatcattataggcaaccacttttacggttcccggctcatactttgtatccatccacatcaaacggtagcgtttctggcgtttgaaatctgctatggaagcagaatccgcactattttcagccgttacagtcaaatctttggtacgcttaccctgactcttgccattgataaacacttctgccgacggataatttgtataaacaaagataggagtcacttctccttcacgtcccggccatgtccaatgaggaaggatatgcagcgtttcttcatctttgttccaatgactgcggtacagatagtaacggtctttgggcaatccggccaggtcgatgataccgaacaaagaagaatggctgggccaatcagtataataaggagtcggttcgcccaaataatcgaagcccgtccatacaaattctccgataccccatgcgttatcctcatgccaaatccagtcatcctccggcaaattggaccaaccacaatgttccacatcgtaagaagaagactgatgatcgtcatatttcttcatagcctgacggacaacagggaatttatagacgccacgcgaacttactgtagaagctgtttcactacctagaataatctgctgaggcaatttcttatagttttctggatatttatgagggcggtaattgaaaccggccacatccatcacagcagccatattattatttactacagcatcaggcgcatccataccttgtgttacaggacgggtaggatcttcacgatgacagatatcctgtaacatacgcgaaagctttggtccgttattgccattccactggtcgggtacttcgttaccgatgcaccacataacaatactcggattgttacggtaatgacggatcagattagtcagatccttctccacccattcatcaaatattttatgataaccgttggccatctttgccgatttccactcgtcgaaagactccaccatcagcatcatacccatttcatcacaagcctccaccaattcgggtgccggcatattatgagaagtacggatggcattacaacccatatctttcagaatacgaatctgacgacgtatagcggcatcatttacagcaccgcctaacggacccaagtcatgatggttacatacccctttgaatttggtcagctttccattcaggaaaaagcccttgccgggaacaatctccaaagtacggataccaaagcgggtggtatattcgtctttcaaggtattcccttcatatactttggattcagctgtataaagaaccggagtatcaggactccacaactcaggattagccactgcaaactcctgttcaaacaaagcattatcaaaaacactcaacttgttttccccggtagcaaccactttgccgtttttatccttgatctgcgtcacaatacggtaattatccttattagctccttcagggctaaccaaagaagttttcaaagacacttttgcatatttgtctgtcaccacaggagtggtaacatacgtcccccaagcaggaatatgcgtatcttcattgattaccagatgaacattgcggtacaatccggcccccggataccaacgtgatgattcaggctcgttttccaaacggactgccagttcgttcctctcacccggtttcagataaggggtcgcatccacataaaaagaattataaccgtagggccaataaccggcctcctgcccgttcacataaacacgggcatggctcattgctccatcaaatatcaaagtcgctttcttgcctttctcaaaaccgggagcatcaaagttcaggcgataccatccggttcctacaaacggaagacctccggtacgtccggcatgttccatcgcctcggtctgtccatcttgagtaatagccatttcctgcttgtcgttattgatactgaacggaccataaatcgcccaatcatgaggaacggtgacgttctgccatttactgtcattataaccgggattggcaaattccgcattatcttcacgcgtaaatttccaccctttttcgaaagtctgctctgtacgtacctgcgcttgcaaaaaagcaaaataacaaacagctcctaacgcagcacacaaaaatcgtttcgtattcatagttatttcttattaggattttctgttactataaaagtaatttcacctgccttgatcaaatcatcatgcgaaatcaaatatttattaatcttcttattgcccagtctgatttcctttatataatccccttgtccttctttcttgataaccaattctttcttgccccaatatttaggatcaagctgaacggtcactttatcaaaagtaggagtggtcaatgtatattcgggcacacccggacaatccggatagaatcccatcatactgaatatagcccatgcagacatcgtacccgtatcatcattgccgggaattccatccggcttagttgtgaaatacttagccagcaattccttcaccaatttctgtgtacgccattcttcacctttgaaacgactgaacaggtaaggataggctatatcgggttcattggccggatcataattcccttcatcaaacacgctttgcaatttatcaacaaatttcttgtcgccccccatcaactttaccaagccattgatatcatgaggcacaaagaaagtgtaattccatgcattaccttcatggaaaccgggactaggtgcaaaattagctccttctttcggatcaaacggttcatagaatttgccttctttagttatcggacgcaaggttccgaaatccttgctataataatttttatagcccatagaacgtttgcggaacaatttcgcatcttctttcttacctaaagcctccgccaaggtagaaagtgcatagtcggcaacatagtattccaaagcatgagaaaccgaattatcatactgactttccatcggcacataccctttggacatataatcgtcattatccggacgcatcagattatccttgcccggagtagtggccgacttatacattcccttataagcttcgtcaatgtcaaagtcttgcaatcccttcatccaactgtctaccagaacaggaatagaagggtcaccttccatcgtcaatgtttcacgaccatacaattcccatttcgggaaccatccgtgttccttgtatatgcccatcatggtgtgaatcatatccatctgacgctccggatataccaaagtcatcaactggtgatagttacgataagtatcccacaatgagaataccgtgtaacggttatggttggtggtcaaaatcttatctccctccatttgtggatattgtccgcttacatcctgcaaaatattcggatgaaccatcgtgtgatacatagcggtatagaatactcctttttgctcttccgttccaccttccactttgatacgggaaagatcatcgttccatttcttacgggcttccgcacgcagtttgtcgaatgttgtaccgaaaggctgttctttttccagattcaaacgggcattctctatgctgacaaaagacacgcccatactgacttcaatcacttcttccgctgtggtatcgtaagtaaaccacactcctatatcatctccgcttatttcttttgtataagcagtatagagtttgtatttaccggccgtatcatcccattgcgcctccacacccatcggacgcatcattttccaataaccgcgttttgccggtactttgttgatacgcattacaaaatagataggaaataccgcctgaggattataacagaaagttcccaacaatttggtaccttcaatctcacggtcgtttacaaaacgaacggtagcaccactctcattggtcaatccctctcccagattcaacaagatattgctttgtccggcaggaaaagtaaagcgtgccatactggtacgtggagtggcagtcagttcacatttcacattgtatttatccagtatattggtataataacccggatttgcagtttcaccttgatagaagcttccataattatgataatccacatccagtttgccggtggtaggcattaataacaatgatcccaattccggacagcctaccccgctaagattaacgtgcgcaaagccggtaagatatttattattgaattcgtatggagtggaccaccattgcttgtctttatccttatccccttcgggaacccccatcacattgaaaggagtcaccgacatcattccatgaggggttaatgctccggggtttgtcgtaccgtaattagtagtacccacaaaagggtttacataatctaccggctctttctgtgctgccgcagaaaaaactgagatacaagccagaacagccgataacaaaatttgtttcttcatgctatttgttgtttatataagttctattatttcactacaatttcatctgtaaacaagaaacctccgaattcgcccgaagatgcctgataacgtatgtaacgtgctttggcatttccttcccaaccaaagttgatgaaagtcactttgtcatccttcactactttatgctccatgcgcttcagttccgtaaactccttaccatcattggaaacggaaatgatcacttctgaaggcataaagacttcaggtccacacacctgcataaagtctgctccaacagaatgaatttctgtttctttttccatatcaatggtcacatccattcttttcttgtctataaaaccttgccaacgcctgtcaccataagtccagcctccgatcacaccatctaccaaggcactgtcaccaccggccgaatagccgggataataagcggcatccggtccgtaagccactttcttacctactgccaaatgctgtacgggctgatccgctcccggacgatttcctatctcatttttcaattcaaaaggatggtatccttcagctttcaatgcctctacctctttcaatgcacgaacatgaaaatcatcatagttcttcacagaaggggcactccaagcaacttccgccaaggcaagaatacgaggataaatcatcatttccgcatgttccggagtcggaatatattctgtgaataaattagcttgtactccatacaccaactggactttatccgcactcaaagtatcgggtacaggattaaatgaataaactttggacaaaggcagatagcctcctattgcttccggctgggaatcaggagcatcctgataagaatcaaaatagcagaactcacccggactcataatagccatgtggccggaatcaaccgctttcattcccccttccgtgccacgccatgacatgacagtggcattaggtgccaaaccaccttccaatatttcatcccaacccaataatttacgtccgtgggcattcaaaaagacctcaatacgatgaatcagataactctgtaactcgttcacatctttcaagccttcttttttcatacgtgcctggcacagtttgcaagtgggccatgaggctttacctgcctcatcccctcctatatgaatatattcggacgggaaaagttccattacctctgtcaacacattttccagaaactcgaaagtcttttcattaccgacacagaaatcggcttgtttgtaaggttcgtgtgtacaagacaactcaggataagcagtcagtacttcttccgaatgcgcaggcatctctatctcaggaataacagtaataaaacgttcctgagcgtatgccaccagttcgcggatatcatcttgagtataataacctccgtgagcatctttactgccttcttcttcataccgtcgtccgttattccaccattctttccaggtaggaaactcacgccatgccgcaaattctgtcagacggggatatttttttatttcaagacgccagcccgcagcgtcagtaagatgcagatgcagacggttcaatttataatatgccaaagcatccatctgcttttttataaattccttatcgaagaaatgacgggaaacatccatcataaagccacgataagcaaaacggggttcatctgtaatgactcctgccggcaatcctttttcatcaaccatttgcagcatagtctgaactccatagaacaatcctgccccggaagttgcacgaataagtacctgatcaggagttaccgtcagaacatatccctcggaagagtttacctccggcagttccgccacttgtttcaagacaacattatgtccctcttctgctattaccggtttcaaattcatggaagaagccaccagataatcttccaaaatcttcttgtccccctcagacgcatctatatataaccctgtttccgaattcaatgaaaacacttcctgctgtaattccacctttaatggtgcgggaataacagaaagtgtgcgttgctcttctttcgtgcaacttgcaaacagcaagcccaatgcaacttccgccaatataatcaatcttctcatcttctcttttctttaattctattaatttcattagtacgaatgcctggtttcaattctccattaataatgtaatgaaatccgtcctgcgaaactattacagctccggcacgcgcaccttgttcatattcgcctaatgtagtccatttatccgtctgcggatgatagagcagcaggtttctattaaaccgataccactctacaggatgtgacaaatattcttttcccgcataaataccttgcagagcttttaagaatatatccttatcaactcctccggcacacaatatcataccctcgccaaaagaggttcccattccaccacctaaagagatctcattaccttccgcatcatacggggtggcaaccgatgaccattctttcgtttccggagaatacatatatccatctactgacaaagaagcctgatgcccttcaacagccggggcaaatcccccccacacataaagttttccatcttgtgccacgcaaacagattgtactctgggttcacccggaatatctgtttctcttttccatcctccagacaaatccgacagatcaagcatgtacatggccgaggatggaatgccatttacatttccaccgacaatatataatgaatgtcctactaatgcacctgccatattatccatagttacaggcaaagagggcaaagtatctcttttcaaggtgtctttttgcaaagataaaagaaaaacatcagacaagctgtgtgttgccgtagtccctccaacacaaattaaccctttttcagtagaaatagtgactccataagctgctgcctgaggcagttggcctattttcttccactcaaaagccgtatcatttgacaaaggggcgatatatatatcccgataataagctttttttcctccatcggctaccggtatatcagggaaattacaacctccggctatcagcaaatttccttcaatcactcccgcatataatgcagaaactcccttaagaaaaccggtattctctgtagggaacccatgcattttctcaagagatatttcagaagcatccgattgaccgctacaagcagccattgtcatcatgcccagtatcgcataaacgccatatattatttttctgatcatgttttcatggtgaagcaaataataaaaagtgtgccaaaagcaaatcagccatcccgcttgccccagaaacggattgcaccaacgcaaacacagcattccttacgcatatggacggaggcattccacctcacgcccaacggtactctatcacacttttggcacacagtcattatttgaatataactatcaatttaatgaaatttcatcaacaaacaagaaagccggatttcctttgccaccgtgccaagcaggaatgctatgttccgctaaagcggtcactttcacataacgggcagtcaccggatcgaaagtcaacgtatggttgaacactccattcttgtcatcctgcttcattgccggatatttttctgaagcaatttccttaaagttctttccgtcttcggatacagctacagaaaaagcacgggcatcaaacacccagtcacctttttccacacaagtagaaatagaagcgctgctgatttctgtcggttgctgcatatcaataactgcttccatatcatttttatagaaagcaatccaacggcccgtcttatagttaccgttacctttcaatccgtccaccaaagtgggagcgcctttgaattcatattgcttgtttaccggttgcaacatagtgacaggtttcatactagccttgttaaaagcaatttcctctgtaaccacacggctatttcctgcaggacgtacagtaatcgctttaaaagtacaattctgtttcaatttcaatgtttccgtatacaactgggaagcagcggaaggttccgttccatccaaagtgtaatagataggactattatcaatagtagacaaagtaacatccagcgtaccatctttcggattaggagtaaatacagcatttacatcaaagacatgcttggcataattatatttataaacatcataaatatctaccaactgaggcaaacgcttcaagaaaccttcatagtttttcttttccggcatggtccactgaatttcagacaaagcagccatacggggtaattccatatattctacctgactgtaggtaggaatgtattcagtccataagttggcctgtacgccaatgatgtatttctgctcttccggagtcagatcagccggcatcggctcatagttatataccgtttcaacgggtacatatccaccaatagcctcaggttcattagcaatatccttggtttggtaatagtcgaaatacaaataagtattaggagtcataattacatcatgtttctgttttgcggcttcaatacctccggcaacaccacgccatgacattacagtggcattgggagccaatccgccttccagaatttcatcccaaccgataatctgacgtccgtgtccgttcaggaacttctctgcatgattgataatgaaactctgcaatctttcctcggcagtatgattcttgtcagacttaagacctaaagccttgatacgagcctggcactttggacattttgcccaacgtaccttaggacattcgtcaccacctacatgaatatattctgatgggaaaatctgaataatttcccctaatacatcttcaatgaatttcaaggtttcatcatttcctgcgcaaagcacatcttctgataccccccagattttccatacttcgtacggaccaccagtacagcccaagttaggatatgcagccaaagcagcctgcatgtgtcccggcatatcaatttccggtataaccgtaatatgacgttcggcagcataagctacaatttcttttgcttcttcctgtgtgaagaatccaccataaggcttgccatcatattttcccgagttatgtccgataaccgtttccgctcttttagaacctatttcagtcagttcaggacgactcttgatttcgattctccatccctggtcttcagacaaatgccagtggaaacggttgatgttgtgcaaagccagcatatcaataaaacgctttactgaatctaccgggaaaaaatgacgtgacacatccaacattgcaccacgataagagaaacgaggatagtcattgatttcaaccgccggtaaagcgatatccactccttgtgctaccggaatagatttacgcaacgtctggatgccataaaatactccggcttccgtaggtcctgaaataaccacttggtcgctggttacctttaactggtatccttcaggattttcagcatttccacctaattgcaggattattcctttgccgtctgtgccggcttgtacagccaatgactttccggtaagatctttgatataacttgccaaaaattcagcgttcttttgcattttttcattgccttccggatacattatcttagttccatttgacaaaataaacggagcatcctgatccattaccgaaatttcctgcggtaacggaattatctgataatttgcttctttcacttctgtgttacaggataaaagcataaaacctgccattgtcagccctgcaaggcccattaaagttttcataatagatattaattgattagttagtatcacttaattgcttaatagttatatcaaccttttcattcttcttcagtttatctgaagtaataatcactttctttgtctgtcccggcaacaagtcaaagaagttgtcagtaaatctcgcaccttgaacaggaatctctatgaacacatccctggccagctgtctggcagacagagtcacttcatattttccatccatcggcttcactttatagcggatctcagtcttcggaagctcctgatcttttgcgtggttaaagtaataaatttcttcggataaaacctcacctttcttattttttaatgtcattagaagaaaagtattttgaggacttgttgttatacccgcataaggttccttataatataaggtggaagcattggccggaacctcacccttgatactctttttagtcagaacttttccattaaagtccatcacacgcaacaataaagtcacctctttatccgcttccaacttgtccgacataacgtaaatattcaaatcctccccttccttgacagcatctaccaataccggagcaaaagctctttttgcctgataatgcaacgctttccaattgccataatagtcaatgctagaccatgaaacaaccggccagctgtcattcaactgccaatataaagtccccatacaatagggacggttacgacgatgggcttccaaaccctggcgcactcctaccccctgcaaaaccaaacccatataaaccaactgatcgaaatcttcaggcactttataatacagtcccatagtcttcttgatgaggaaattaccgatagtggctttttgatgagcattcatcacctccgattccaatgcataatcttccggtgaggcaaaagtagcaatcgtcttcatttcaggaaatgcctgaaaaccaaactcactcataaaacgcggaatttccgtatccagactttcaaacggtttctgaccataccagataccccaattatggctgtcggcaatcttccaactttcgggacgtccccaattggcctcgtacggagaaccatgcatatagaaacggtccggatcaagttcagctactttacgaggcaacaactcacggaaaagtttgtcatagccctgcttcattccttccataataccgggatcagtgtatttcttatcccatccccagtagcgcataccttcataaatttcattgtttccacaccacatagccagactggcatggttccgtaaacgcttgatattatattccgcctcggcctctacccgtttcataaaagcaggatcggacggataagtagtgcaggcaaaaataaaatcctgccaaactaaaattccattctcgtccgccgcctggtaaaaagcatcatcctcataaattcctccaccccatacacgaatcatattcatattggcatctttcacatccttgaacaactggcggtaacgttcttcagtaatgttaggcagcaaagcatcatccgggataaaattcgcgcctttggcaaacataggttcaccattgactacaaaatagaaggattctccctgatcgtctttttctttcaccacctttattgtacggagtccgatacgctctttttgagaagctatcactttaccatccacctttattacggcttcaaagtcatacaatgcaggttccccccaaccattaggcatccataaatgaggctgccgtatctctatgggaagaagaatatggtttgttcccggctgcaatgtcacctctttctgttcggttaccttttcaccctccttataagaataagcaacagttacttccgctttctgaggagttgcagaaacactgtttacagtcaggcggttttcaactttcgccagatcttttgttaccgaagcctgacgtacatagtaatcatcaatgcgtgccacatcatagaaagtcagtgtcacaggccgccagataccactggttaccaagcggattccccaatcccagccataactgtaaggcgctttacggctatagatactaacccgcttatcactatgatcattatcagcaggataatcaaaaccattggtttcccattggggtaaagtttgcttgacaggtgaatgaaacagaatctgcaaatggttttctcccttccgcaacacctcttttaccggaagagtatagccgacaaacatattgtccgtacgttccaacaaagagccgttcaggtaaatatccgcatacgtatccaacccttccaaaatcaacaaggcagcatcccgcgagagttgctcatccgtcacattaaaagtagttttataaacccagtcctcattctctacccactgcactttttgctcattcatcccataaaatggattgggcagcttattatgagaaatcaaatcctgatgtaccgttccgggcaccgtagccggcaaccattcattccggccgacctgggcgaactcccatcccttatcaagactcagactctctgatttcttatactcctttgcactgagcatcatcggaaagcatcctaacatcatcaaaacttttaatgttttcttcatcttacctatctttattaattcatatactattcagcccggaatgtggatgcaggcaaaccggcgccatttaccagattggcacaggtaaatggctgccatccgtaacgaaccgtttccggctctttcaccttgtcactccatacttttattttaccgttttcaacaacagcctgtgccggataaaataatccatcatcacctgccacttcgaatgtacgaagcggtttcccatccgaagtggacaacccctccgcataatcaaaagaaatataagccgcacctccactaaatacgaccgatttataaagcggtcccgaaggaatgacatttttatatccgtatgttttattcaaagcccatgcagccaaccgttcaccgacttctcttttctgtttgggatgtacgtccaatgagtctcccctatctgaactgacagccataccggtatgaggaatctccgccatcaaacgacgctggctatcacggaaccaagtccatgacggacggtctatactggacaattggacaaaatagaatggaagttccgcatccccccaattcttgcgccaactttccaccaacaatccgaacaacctttcatgagcctcccgattatgggcattagactcaccctgataccaaataaagcctttgaccggaaactgttccaaaggacggatacccgattcatacaaataacaaggctcataaggatggcgttgcaatttattggaagactgctttacattcaaggcagcacgcccacgcacccagtcttggataaaatcattctgcatccaattacgtaagatagccgggaaacgatattccaatgtactacggtctatccatgcttcagtaggagatccgccaatggcattgcaaatcagtcctacagggacttgcaaactatcctgcaatttctttccgaaatagtaagccaccgccgagaaattaccggctgtttcaggcgaacaaactgtccaccgtgtatccttataatattgcagatgattcaatgaatcgagtaccgaagcatcccactccaccgcatccgtacgccaacgggctttcatatcatataaacggatattgctatttgcagcttgaggaacatcttgtgcggcagtcgcactccaattcagataaaactccatattcgattgtccggaacagagccacacttctcccgccaacacattttcatagaccagtttccgtttttctgtagaaacagtcagcgtatatggactgcccgccttcaatggccggacatccaccgcccactttccatctgctcccgtcacagcctgaagttgctgcctgtctatggaaacagttactttctcaccggcatccgcttttccctgaatagtcagcagacgtccatgctgcaataccatattgtccgtataaatttccggcatttgcaaaccgccaaaatcaccggttatgccttcatacaccgtttttgccaagacagccgcaccttccttatcaggatggacagcatcgggcaacataaaaggatatggatataaaggtgcatggaaatctatcaactgtacttgtgcgtatttcgctatcgtttctatagccagctgaatctcatcatgccagtcgcgtgtgccggactcaaaccgcggatggcggtcggcaatcggagtcagacgggcaatcaaaatacgacattcaggattcgccactctgaacgaatcaatcagtgcacgataatccgctataaaaaaatcacggtaattgggccaatcacgcggatctgtatcattcactcctaaatgaataaccactacatcaccggcaaaagccaatgcatccttaaactctttctgttgcataaaaggccggtgtcccttgttcagcaacgtagctcccggctttccaaaacgctccaccgtatacccttcacccagcatttgctgtaaccgggcaggataggactccttatcaggatcggatacacctatgccataggtaatgctattacctacacaagcaaccttcacccgcttccgtgcaaatgaaacggtacaaagaaacaaacataaaatcagtattaatgtcttcttcatttctggtcaacataaggttttacaatatcacgccacagcaagtatccctttcctaataaatgtaatccgtcattagtatatactggattcatcttgcctgtctctttctccacaaaatgactatacaaatcaatataggcagctccttcctttaccgccaatggttccaacaaatcattaatttgttttaccacctgccagcgtgatgtatgcccgttaaacataccgtaacaatcattcaccggcaatacactttgcaaatataattttgtttttggagattcttgctttattttccgaacaatcatacttatttctgaaataattttatccgcagacgttccccgagaaacatcattgataccgatcaataaaaaaatctttgccggttttccctttacaatcggatccaaacggtcatatacccccatacagatatctccactgatacccctgttcttcacattcttattttggaacaactcagcccactcgcaaccgttggtaatactgttccctaaaaaaataatatcttttgaagtaaccggaagttcttcaaacaaagtcgctctctgctcataaaaagtagaatacttgcgttcctgagcaaactggggtaacgctaataataatcccaataacaataagacaatacgtttcattttatttttgtttatctggtgaataaatcaatccctctaccgccctttctccgtcaggagtcacaaagacagcagtaaacatccacttcacaagacgcgtctcagccatcttaaacttgccgataggcaactttaagaaaaccttgttccaacctttatttaaatgcaccgccaatggcactcttcctacgcaattctcatttcccaaaggtacttcataacttttcaccttatgcgtagcagtccatacaggaggtaatatttcacgatcattaatccagatacggcttcccttataatcccatttgtcaggcaatggcgccagatccatctctgaacggctataattctgaaactctgcccataaccccacttcctggtctttgggcgaatacacccaagtatatgcataagccgtgtggttttccttaggatcagcataaaaagcaggaaccatatccccccagacatggcgtaaataaatacctgcccctattgcctgacgtacaccatacgtattcccgttataatgataggtatcctttaattcctgttcaggcgggaacaccttatccatatctcccccattaggaaaagcatccgtaatattccattttacattagtctgttttacataggcgaaaggatatcctttaaacgtatgctccttatgccacaacatacgcttttcaaaatcagcgaattctttgaatgcttccgtgtcttcgggtggaagtatcgtacccagtccgtcaaaatattccgtacctccccctctccaggcacgctcggcaatagcaagcatattgggatacaagccattttcaataaccagattccactcattgtcaatcaaacgatcgtgccacaaagccaatatagttcccgcaatgtcctcactgccttctgcctgatcataaatacggctgttgtacaaagctacaatatcaccgaaaacatcaaaatgattcagataatgaaatttggaatcgatagcaggaatacccggttgcgcctttccacggtaactccacaaatgtgtcatgtctatttcccccggtttatagtgccagcccggattccaggatattacttttttcccttttgagcgtacatacgccactatttcgggtacaaaatgcggattggtaaactccacctcatccgtacctatatgtaaataaggcacatcaaatgtctcacacacctcatccagcaacagtttcaatattttcatcccttccggactttgcatatcatggcggaaagcacgcacaaaggcagcactatgccccggcatatctatctcaggaatcaacaacacctgatgtttcttacaaaaatccaccaaatcgcgtgcctcttccagcgtataatatttacccggcatacggatggtattcacactatcattcagcataggaaagattttactttccaatctccatgcctggttttcagtaagatgccaatgaaatacattaatcttaaaccgagataaaatctcgatctctcttttcaattcttccattgaaatataactgcgtcccacatcctgcataaatccgcgtatccggaatgccggccagtctacaatctcacatccggcaacagaacttctcttcccttttttccgttccaattgccgaagtgtctgcatagcccaatacactccctgttctgttacagcctctatctttatccgcttgtttgaaacagaaagacgataggcttcagccccgtttagcctggcttcctcaatagacggaaccagttccacttcaatcaccgatgacgagtgttcaacaatctcaccacctgcattcatgataaaaacttcccactccggcctcaacaccggagtagaaagtttcacctttcccatagtaaagttcttccccgtatccttatacaactgaggtttaggaagtaacgagatactggtttgtgctatagttacagcacaaaccagtatcataccaataaaactagaaaatctgcgtttcattatttatttggtcttaataatatctttcagctttatcgcttggaaagtcatgtgggccacactgctttcatataaaattcctactgtttccttgtcaatcatagtcaagcagctgtatccccaaccccaaccggcatccagcagcaattgattctcgggcaaccaagtcaccccaccatccagacttgctttgatggtaatgctatgacggttcttggcatcattcggattagagaacaaaaggatgtctttacccaatacattctctttagctttaacactaatcaaactggccatacaaaccggttcctgtaaggctgtacgtgaagactcatgttctttccatgttttacctaaatctgtagttgtagaaacggcacgactgccaccacgattatcacgcatattcagcatcagcactcccggttccacttccgctacctgagattcagttgtattagtgcgtgccaatgtactgatattccaggtttttccatgatccttactgtatataataccggcattaggaatacggtcattgccaatatactggctggcaaagaccaatgttccatcttccatagagatacctctaccgggaccttgcagcaagaaataccatgacggatctttcacctgttctgttatattcataggctccgaccaggtcttaccatcatcatcacttttcaccatcattaattgtgctgtatgattacggtccatgcctgtttgtgaattccaccacgcacgcccatttcccataccatgtgtccaggcagcgacaatccagatagttcctgtcttcttatcaaccaaaatggccggatcgcctactccattctgtgctttaggcaacccatcatattcaccaaatgccatcggaatgcgcattttctcccaagtctgacctccgtccgtacttctgctcagacctatttccacatactcctgtaaatccgcactattattatagcgtacatcatatacccccaacaaggttcctttatttgaagtggccaatccgggaatacgataggcagcagccccgtcgtcaccggcatggcgcacgccgatccccatataatgggtacccgccttacgggctatcttcaaaggagcaacctgtccgtcaatcttagcttccaccacttctgccgacactttggacaagatagaagcaacaggcttcatttgcaggctaatccaaaaataattcactcccggaaacaatttttggtcagctttcaatacaacctcacgcttcggggctttcacttccgacttcaaaacggaataagaagtattggcagccaatgtttttcccggagtattattagatatataatctaccggagcaaaataagtctttcccctcctctccacgctttcagttccaccataatacagtttcacagattcaatttcattcaaattcacgtctttgccaaagtccaacttcacttcattcagcatctgactttgagcagcctctatacgcaaatgaaacaactcattatcctgcctttcaatcaacacaggaatccgggtttcgcggacaacaaccgtatctgccgccgcactcaacttgaagggtgctaatataaaaacaacaattagcagtaataagctagggtttctcataatatttataattttacgggtgtaaaaataaaagtttttattgaaattagaaaataaaaagacggtttctttattaatttcataaagaacaccgtctttttatgcaattaaagattcttatccgacaaaaatttaataaccaaccgtttgtttcaacaatggattattagtaagagctccttggttgataggccaaagcagacgggcaggctccgccggagtatagtcaagcacgtacgaatcgccaaaacgcctcaagtcataccatcgtttaccttccagcataaattcaaacaaacgttcctgcaagacagcatccgccggacgcttatcgacttcctgattgggaaaccccactgttgaagcatcatacgcatcaccaaatgcacgccggcgcacccggtttatctctgtagccggatcctcacccaaaagcactttcgcctcagccagcatcaatagcaaatccgaatatctataaataggataatcatcacatctcacccgtgtactcccattcataactccccaatacttatgcggatacacccccaccaattccaacttgccattttccaccttattatatacatctttcaatgtaacgtcacgacgggtgtctcccggcagaaacttcttgaagttttccaatttcaccatcaggcgcatgataccgaaattattctcgaccgacgtatttatcaaagtaccatccgcattatagaatttccctaaataatcagcctgtggaaacaaatcattatttccattccacagattgtattcaaacaattcattatgaatggtaaagataatctctttattacctttattatcataagcaaacactccctgataagtatccatcaagtccagattgctacggctgatattattctgtatgtcaaccaacgcattctttgctgtccgggcatctccttctcccccgtcacgatgggcactccacagatatacatccgctttcagcatcaatgtggcagcctttgaccacagcgattttttttcctttatggtataatcggatccaaaataacttaatgaagattctatatctttttttacctgctcaaagatttcggcagccggagtcgccgcctttgccagtttacccacttcaaaacccaggctaggctcttccgtaaacacgacatctccccatgaacgatatagctgatacatatagtaagcacgcaatccatacacctgtcccaaataataattcctggcactttcagtcagcacatccgtatgaagagttctgctgataaacaagttcatctggttgatattctgatacaaatcaccaaacccgctgattccgggattctccgcattcaatgtattataaggaaaacgttccatcccctgggtagcttctccaccgaaaggaattcccccaaagacatcacttcttgcctcacccaacaaaaacatattccacgaatggctcctgaagcgactatgcagtccaaaaacaaatgaatcaaactgttccggagttttccagtaattcaagtcagtgatatcgctcaccgggtccatatccaacgaagtacatccaccggccaacatagccgatgcggcaaaagccaatattatcttttttatgttcataccttttcttttttacacattaaaatgacaattgtaaaccaaacaggacggttcttggtgtaggatagcgtccattgtctataccgccacgaccatttgcctgaatatccataaccggttccggagaagttccatcatatccggtaatatagaataaattctgtcccgtaacatacacggacgcatcggtcaagaacaccttatttataagattcttcgggaatttataactcaaggttacctcacgcagacacaaataatcccccttttcatagaaagtagagttattattgttcagattcgttgtaccattattggaacgggtaatgttctttttcgcattctggtcggcccaatagaatttaggaatactagtttccgtattgttttcagaccacgaatttctgacatccgtaatcaaattgaacgacccgttatactgccccaagattcttgctttcaaatcattgtaaatggtatgacccaccgcatagtcaaaacgaccatacaaagaccagtttttatagttcagcgtggtagaaaaaccaccggtccatttcggataaatattacccaccacctgacggtcgtatgaatttataacattatccccattcttgtcatcccacagtacatctcccggctcaatgggtttccatcccggtttacccgcatattcggcagccttattcggcccatacaggttggcaacctcatccacaaaatcaccggcatgatttctcacatcatcccagtcacgcaagatacgcacttgtttataagcaatgatatcacccaagctttttccttcttgaatgccgcctacccaaaccaacgagttggattttggatcccatacctgctcacccccctgacggttgtttacattcccgttaaaaggcagcttcttcaccatatttttcacaaacgaagtattagcggtgacatcccatgaccagtccttccttgtcagcagattcaccttggcttccagttcgaaaccacagttgctgatagtacccagattcgttttgaacgagggaaatcctgtatattccggcaaattcacatcagtcagcaaatcggaagtcgtgcggtcataatagtccataatcatatgaatacgattattgaaaaagcccaagtcaagccccagttcaaacgtatggctcttttcccaacgcaatttactattgaccacccctgtattcaaataacccagattaccattataagcacctaccgaaccatatttaccatatacatcaaaattaccgataccgtttacattaccgttcaacccataactgatacgcggtttaatcaaggatactacttccgcaaactttgaatctttaaagaaagcttcctcatgcacattccaaccggcagatatacccggaaaaaatccccaacgattgtcggacaatttggaaataccgtcataacgggctaccaaggacaccatataacgataattataatcatagttaacacgggcgaaaccggaaagaatgcgatatccggttttgacagaagtagtataagtacggttagtgcccgcatttaaagtaggtatatcatctgtaggagcaccggaaacacgcgcttccaggttctgatactgataatcaaaatactcaccacctgccatggcattgatattatgtccgctaaaaccttttttatattccagagtcaatgcatgctgttgttgaaaaacttttgtatttgtttgagaagcattacgattggtattgggagcttgtcctatctgttgatatttcttttcaaacagttcaaactgactgtctgtataatacatagaactgtttccattcaggaacaattgctgcggaaggatttccaaagcaaaaccgatattaaacgaagtcttacggttcgttgtagaacgagtcagtttatctttccaataataaggattaccatcctgattactccatccggcagcaggacttccatcctcattccacggattccaagtgggaaacatactcatggtacgatagaacaactcatactctcccgtttctccgttccaagggcttttcaagtcgtaagtccataaatcgggcatcttggaccatgaaaaactaccgccggcattcactgtcaaaacgggcaacaacttgtatgaaccgttgatagtcccgttcacacgctgataattggtagaaattatctgaccgtcttccgaataataccctaaagatgaggaaaatgttcctttgtcattacctcccgacaaattcagataatgatcttgtgtaaacgcggcattgcggaaagtcagatcatgcagctcaccggcatggtttctaaaaatcaaagttttatcagggtccacaggatccgccatagaccgccatccttcattcagcaaatgtttgtttgcatctgtcataaaggccagatccactccggagttaaccccaaaacctttctggttctccatacttgtaccgccattggtacgctgccaacctaaacgttgataatacaaatagtcaccggcatccaaatacttatacccttcacgtgcaaagttcacaccccctttgaacttataagtaatttgtgtcctgccttccacccccttcttggttgtcaccagaattacgccgttattggcacgggcaccataaatagctgtggaagccgcatctttcagcacctgtatggattcaatatctgaaggattgatatcatccatagaacgcacaaggccatccaccacgaccaacggcccttccagattcttgtttatggaagcaccaccacgcaaaacgatattgggcgaactacccggtttacccgaagtatttgtcacacgcaatccgctgacagttccctgcaaggattgggccgcattactcatagctgcattttgtaatactttatcatccaactttgaaatagagttcgtcatcaacgaacgtttctgactcattccataaccggtcaccacgacctcatccagcatttctgcatcttcttttaaaataaccttgtaggtgtttggcactcccactacaatttgttgtgttttgtaacctatataactcacatccagttttgcccccacaggcacttggatagtaaagttaccgtctacatcagttattgtaccatttgttgtccccacctccaggacactcgctccgataacaggttcaccggtggcatctaccactacccctgttatcgtttttgtttgcgccatcatgtttattgcaaaacagaggcatacgataaaaaagagagctttcttcatgaatctcagatttggttgataaattaatgtttaaataaaaaagtttaattaagtgttagttttaaaacccctcaaaaagaaaataattttaaaatcaacagcgaatatatacacgtatatttagtatatacaagaaacaaaaggaactatattctttattagtctttgttttttagaataaactaaatattaaggcatattttaaaaagttacataagggaataactcaaaaaaggaaaaaaggttcatacggagaagatataacaagaaaaaacctccttgcaattctttgcaaagaggttactgaattgtacacccgatgagaatcgaactcatatcgtcggaaccggaatccggtattctatccattgaactacgggtgcgtctgaaacttggacgtgcaaaagtacaaaatatattgtctttatcctaataatttgggatatttatctatcaaaataatattttgctcattaatttaagtatagaacaatcaatttgattatattttcggctaaacatataacaatatcacaaataatttctatatttgcaagcaattaaaacaactagatctattttacaatgagttacctaattaaaccagctaactataaagccttgcttgatttaaaacaaacagagttaggcattaagcaaataaaagagttctttcaacagaacctgtcgtcagaattacgtctgcgccgtgtcaccgccccgctatttgtattgaagggaatgggtatcaatgatgacttgagcggaaccgaacgggcggtatctttccctattaaagacttgggagacgcacaggccgaagttgtccattcactggcaaaatggaaaaggctgactttggccgattacaatatagagccgggttatggcatctatacagacatgaacgccatccgggctgacgaggaattaggtaatctccactcgctatatgtagaccagtgggactgggagcgtgtaattaccaaagaacaacgcacggttgatttcctgaaacaaatagtaacccgtatttatgcagccatgcgccgcacagaatatatggtatgtgaaatgtacccgcagatcaaacccttcctgccacatgacattcatttcatccactcggaagagctttgccagatgtatcccgacaagagtccgaaagaacgtgaacatgccatctcacaaaaatacggtgcggtatttattataggtataggctgcaaactgagtgacggtaaagaacatgacttgcgcgcacctgactatgacgactataccacaatcaacccggaaaccggacttcccggtctgaatggcgacctgttagtttgggacaaagtactggaccgttccgtcgaactttcctctatgggtatccgtgtagacaaagaagcgctgctccgccaactgacactcagcggacaggaaaaacgtaaagaactgtatttccacaaacgcctgctaaatgaaactcttcctttgtgtatcggcggtggtataggacagtcacgactctgtatgctttatttacagaaagcccacataggtgaaatccaagccagtatatggcccgaagatatgagaaaagaatgcgctcaactgggtatgcaacttatttgattataatctatcagcaatgaaagaagaggatgattataaaaagtcatcctctttttatttgtcatttttacaaattacccctatctttaacgcacattttataataaaagaaatgccatgaacgtacaaatagaagaaagctggaaacaacatctggcacccgaatttgaaaaagattactttatcagactcactgagtttgtaagaagcgaataccagactgccactatttacccaccgggcagatttatattcaacgccttcaatctgtgcccgtttgacaaagtgaaagtcgtcattatcggccaagatccctaccatggtcccggccaggcgcacggactctgcttctctgttaatgacggagtaccttttcctccttccctacaaaatattttcaaagaaatacaaagcgatttgggtgctcccatccctacttcaggcaacctgacccgctgggcgaatcaaggagttttattactcaatgccacactgacggtccgtgcccatcaggcaggctctcatcaacgacagggctgggaggaatttacagatgccgccatccgtgtactggcagaacaacgtgaaaatattgtattcatcttatggggatcttatgcacagaaaaaaggcgccttcatagaccgcaacaagcacctggtactggcttccgcacatccgtcccccctgtcagcctataacggtttctttggcaacaagcacttcagccgtaccaacgaatatttgcaagcgcacgggcaaacacctattgagtggtagacataaataaaaaacagaataaaaaatgagaaatggttgcgtgttgttatcagaaaccatttctcatttttttattcccaacttcttcctagtaccaattcaccgcactacccgtattgcttcgctgatcccatttcaaagcatcggtcagcatactggagttagcacgaatactgaagttataggaagtaaagggaccgaataccaagccacagctcatattgaaacagtgcaggtcacggctgatattgaccgttgtcattgacatctctttcgtattaaaatcatatcccgaagaataattcacattccagcggctacccaacttcacattaccggaaacattcaatgaatgagtcaccgaataaggatatcgcatcgtcttgatattaatctgcttgcttctgtcctcacgaatactataactataactcaaactcaatgaccatggcatcttgaaagccatatagccatccggatctatagccgccttctctgtctttctcaaaccggagttatcttcttcctccgtgttttcattgccatcatcactgtactcatccagattttcattcttcttgtctttatcccccttactgtccttttcatctttcggaccaaaccactttttccacgaatcattattcaatgtatacgagaaagaaccgctatacccctgaaaacgaccaaaacgtccgtatgaccattctgtacggttaccttccactaccttgccgtctttatcaaactcataagcatacgtagcaaactgggcgttcatattaaaagtataactcttggtcagtttcaagcgcagattcatactcaaatttccccaaggtttctctttagccgccgcattataggaaatactggctcccaactggtcaatcaagctgattttcttcactccggtagtatccgcatcggatttcactttcatttccacgttattatctatagagaaagtgaaattctcggatttaccactgggcgagaaagagtaaggcaaaccttcatatggattataagtctgagtacgtacttctccatccgtatcagtataagtatacgttcccacatatccatacctagacgtactgaagtccggcgcataactcatgctcaccgaaggagtaaagacgtgacggatcatttcaatcttgtcgccaaacaatttcttccacggtttgtagaaaccatacatcttggtattcacctgcaagctcaaatcatagttatacacacggttaaaaccgttgattgtatctctccgcacattattaggggccgacggatcataactctgctccaccttgcgcatataccagcgctcggtatagttgaaagaaggcacaacgttgatatatttaaacaaagtgaatgtagcgctgataggaatcttatgctgcataccattagtccatttattcaaaccctgcttcagaatcagattatccttggtattaatcgagttcgtcatctggccggtatattggagtgagattttctcataccaacgttcatcacctaccgctttcttacgcttgaacggataaatacggttcaatgaaatattcaaatccggcaacgtcacactgatagaagagtcacgcgtattctgagagatattgaatgtactggacagattcaatcctatttcggggaaattgcgcgaataactcacactagacgtcttggtgttatttgaatactgctgcgggttgtacaaactactcaggttacgctggtcataactactggtcgcaaagttcacattcgccgaaaaagagctgttagggttagccttggcatcctgtctgtgactccatgcaattctgaaatcttttgtaaccatatagtccggcatattcttctcaccggttttcgttaccagataactggcattgaaattaccgctatatttatatctcttgttataattagactgcacggacagtccccatgaacctttcgtaaagatctcacccaacactttcaaatccatacggtcactgatggcgaaataatatcccccatcacgcaaataaaaaccacgattcatttcatcaccgtatgtaggcataatgaatcctgacgaataactgctgttaaacggaaaaaatccgaaaggaatagcgataggcaacggcacatcctccaccaccagctgggcaggaccgaaaaccacatttttcttaggacgcactttcgccatggaaagtttcagatagaagtgaggatgttcgtgattatcacacgtagtatatcgtccgtgacgcaaataaagttcatcattagcacctttcttcgactcctcactggtaacgtatccttccccctgctgagtaacgatattattaatgaaccccttcttcgacttgaagttataacgcatgatttttgactcatacggagtctcgccatccttaaagacaggagtacctttttccacgccagccgagtcgggaacaccacgggcatacaccgtactgctatccatgttcattgtaatcacggcagaggtcaactctattttctcatagttcaccttaccgtcaccatacagatgggcatatccgccctcagtgaatacgatagagtcatttgcttcataaataacaggcgcatccaacggctgtttctttttaggtgcaaccgtatcgatagacaacgtatctaccaaagcactatctactttcagggaatcattaccggatgcagaattccgctttctgcgttgagcacctgtacttaaagaaagtgacaggcatgcaaatagtagtaggaatgttataaatctatgtcgttttagtggcgtcattcacaaatcatttacgcttttgaggggcaaaattaagcattatccgccaataatgaactatttagcggatatttaatttatttttaaggcttacaagaaacattcgcaccaatggttaaaacggattatcccatcttccccataacgtgaaatactctttaacgccttctccacgctcttttccctgtccagatgcgtctttgagaaaaacttgtcggcaaagcaaataacctgttcttccagcgaaaccggaaccatattccgatgaggaacaggcaactgctggtcaataatactttgcaaagacatacccgctcccgtatgtctctcacagaccaatgcatgacgcggaaatccttctttccgcatcagatcagcccccaaatatccatgacaaatataaggataagatccgaaacaacaaatgccctcagcatccgtcataaaaataccaatatcgtgcagcatcgccgcctcttccagaaactgcttgtccagattcaattccggatgcttgccggcaatccataacgccttatcggccaccgaacggctatgcgccagcaggatatgtttcagttcattatcttcaggataatatttattaatgatagcaaatgcgtccattctcaattaaattcttatttttgtgcaatattacaaaataatcgccacatatcatgaaaacaaaatacattttcctatactgcctcttgtttatctgcaacgccgtgaccgcgcaaaaggttatcaccggagccgaacagatggaccgtctcttacctatattaaaagggaagcgtgtggcattggttgtaaaccaaacctccaaagtaggagaaacccatctgttggacaccctgcttgcagcgcatatacaaataaaaaaggtattcgctcccgaacacggcttccggggtgacgccgatgccggagaaaccatcaggaacggaaaagatacccgcacgggaatacccatcctgtccctttacggtaaaaataagaaacctacagccacacagctacaggacatagacctgattgtgttcgacattcaggatgtaggcgcccgtttctatacctatatcagcaccatgcagtatgtaatggaagcttgtgccgagaaccggaaacaactggtcatcacagaccggcccaatccttgtgattacgtggacggccctgtgcgacagaaaaaccagaaaagttttgtgggtatgcacgccatccccattttacacggttgcactgtaggcgagctggctcaaatgatcaatggcgaaggctggctgcccaatggcaaaaaatgcgcgttgaccgtcatccccgtggaaggctggaaacacggacaaccctattcgcttccggtaaaaccctctcccaacctgcccaacgaccaggcaattgccttatatccttcactctgcccgtttgaaggtacagccatcagtgtgggcagaggtactctttatccttttcaagtaatcggttcaccggatatccgtatctcctccttttctttcagaccggaagccttggaaggctttgacaagaatccgatgtataaaaaccaatactgctatggcaataatctccgccatatcaccgccccgaaaggattctctttaaaatacatcatcacctattatcaagcttatcaagaccttgggaaagcggacaagttctttacccgcccgcaatggttcgacctgctgatagggaaccgtaccgtaagggaacaaatcatgaaaggagccagtgaagaagaaatccgtgcaggatggcagaacgaactggaagcctacaaaaagatgagagagaaatacctgctttatgaataatatttccttccaagctgccggctttcgtcaaaaaaggagacaacaacccaatctattcaggacacgcagcaccattcctctgcatccaccaagccccaaccacaaacggcttcccaaccgccaacacatggaatccgtttcaatcttctttccggaaggcctgcatacctttctcaccaccccgatgatatccgtgtcctcacattcctcataaaaacggcagacgccatctccctgcatcagataacgactgcctcttttttgaataatccgatgcaatacataccggtctgtctgccggaacagaatgacatcaaaaagtttcaactcctccttatcatacggccccaccaccacttcatccttcccatttctcagtaaaggcatcatggaattgcctttcacccggaacttcacgctcctgccacttttgatttccgactccacccacgcaaagaaacattcattcgctatccgcttcatacccatctccatataaagtacgacatactaatttcaccgcctccgcatcgggcaaacactccagatgataaacaggaatggatgaaaccatcttttccaacagactacaaaccccactgtataattcctcctcgtatgcaaatgcaggaggagcagacggatgcaaagctgcataagcctgcaaagtgttcaatctccgtatcttgttatacggtgcttgtgacaaacgtacacatccggccaacggataacgctccgccttataacaaggagtcttcccactccacgggctgccatatacccacacgcccctctcttcataacgcacaatgggactgtcatcattcagcaacttacttcctgctatattttccctccacaaacgggtatgggtactttttccggttccgctttcacctaaaaaaagaaccgctttccccttataaacaatacaactgccatgcaaggcaaccgtctctttccgtaccgtcatcaggccataccccatccataaggcaaaccttaaaagacggggagaataattaccatataaacagatacctctcccggttccacccatcgtccggagataaagcgacggttctccctgcggagccagttccaacaaaaagctatccccacccacaccgaaagtaccggttacatcttcatatccgaacccataggactttctcgtaaaagccggaaaatcccaaccgtttccctcccaaacagtaaaatccggcaaccaagcacccccgtatacatcttttgccgaaaccagatccggttgccaactaaaaggcttgaaaccgctgataccatccaccgcctccatcaacctttcgtccggcaatgcgaagcagtggccacctattttataaattcgatccattgtcttttccatttaatctgattacacgatgacaatatgccaacgagctttcccgatgggctatcgtaagaacagtcagccccctacactccttcatcagaccgagaagcatttcattgacagcccgttcagtctcattatccaatgcagaagtagcctcatccagtagaagcacctccgctttcttatacaaagcacgggctatgcctacccgttgtttctgacctcccgaaagccttcctcccccttcacccaaaggagtatccattccttgcggcaattcatccacccaagcatccaatctcaccagcctcactatctccgctacccgttccttatctatagaccgacatcccaaagcaatgttttccgccaaggtcccatccagcacaaacacttcctgttgcacatatcccaccttgcgatgccattcctgcctcggcacatcggcaagcggcctgccatctatccgaatagcgcctttatccggagtgataaatcccaaaagcagattaaacaaggtagatttacccacgccactctcaccacagatacctacatattcccccttacgaatagtacaacaaaagtcctttagaacctctttactttcaggataagcataggtgaggtgttctatccgtatctctttttgaaaagaaaacgcttcctgcccccatgatggagaaactgcttccatccccttatcccccaacccttcctctataatccgcagagaatagaccgcattctgtacttgtgtccaaccacctaagatgccgcgcaaagcgggtaacagccggaaagccgccacagcaaagacacctaccagcgctttgatatcccctgttccgaaaacggtgagcaaggtcagccccgatatgaccgccatttcggaaaggcaaagaggaagatgctgtatcgtttccagtttcaaacggctctcactgattttccttaccttctgggcgaatacctgctgaagaaaaggaaacgccgcattcagttccaattcggcataccctttcatcgtttccgtgaccagccgggattgctcacgacgagcctgctgctcctgctcaccataacggcgcatcggtttcctgatcccccatccgtaaatcagcatgaaaggcagaaaggcaatatacagcatcagtaccgtcaacggagcgtaaaccaacaaagctgccgtcacccaaaaaacaagcagcagttctcctgtcatgcgaagcaagggggaaagaaggtttaaagaaaaagcataacagatatagttcacctcatatcccagccggatactccccctgctgcgtataaacaataatccccgttgatagtaagaagtaaagagagaaaagctgagccgacggtaaagagacatcagaaaatggttttgaaaacgtgaaagccccgctgccaaagcgtttttcaccaaaataaagactattgccaccagacaaaataacagggcggcatctttatccctcccgtcatccaacagaaaaaacaagacaggcaacagggcagcgagtccggcaaagtcaagtaatgcgcaaagaaatacggcacaaaccacccttatccccattttcctttcatcaggcaacaacaaacggcagattcttttcaacataaaccgcttattttcgttccgtctggaagatggtatggggagagcgcagatgcaacagaatagaatttccaacccatttgcacagtgaaatgcgcaacacgctgttgcacgcacgatgagtatgcagcatacgtttggttttataaaccagaatgccccatttattcttcgccggaactgacatcgtatagggtggccggatgatttcccgcaagatttcctccgccaatccttctcctccatatacaggaacggaagttcctaaataatcattacagaggcgggtcattgccaatatcatatttctaaaacgaatatccgtcacttcctcaggaatatgcaggccgtatctattcagcaggcaagcccagtcgcaaagatgatgaagtgccaggccgcgtgcataatgctgggcggcatgaaaagcgagaaatacggtattaaaggtggaagatgggattaaaatggagcattttccgtccaattccgccgatacgggttgtagcagtttttgaaggagcttatccatcttcactgctatacggtatgtttccgaattaatgaaggttttatgattctctatcggaatacctttatagtaaaacacactatgcttttcggagtgttcaaagtctacctctattcctttttcttccattaaccggtctgccagccggttggcctcggcatcacttttccgggaatggtctgccgaataagtgaagatgtctatatctcccccttccctgtgcgaaggaataggataataggtggagagacccactcctttcaactggaccgtggtaatgccatgcgttttataaaaagctgaaagttcggctatggtatggcagtaccgcaggtagcgtttttcatagttctctaccgccatcgcccagtttaacttcaaagccttcgggggttgcaaacaggccggcagggtttgtattccgtcccatgccaaggccatcactccctgttccactgccagcttatagcaactctgccaagataacaatgacacatcggcaaaaagggcagaattgaccggaatggtgttcaaggctgaacacagcagagcaaacagcattttttctgattggttcaattccatcggttcagtctattataacattacattttttcaatgagctaacccaagccattgcatcttgccgggcttgctgcaccggtatatgataggttttagccaagaaacaacctacctcgtctacagaaaattcctttccgcaaaacttgttccatagaaaacgtgcggaagagttcagcgagataattcgggtgaaatccacatccggtgtaccttgattgattataatggtttctccggctatatagcggagtttgaagttagagttgagtttcataagcaaaatataatgtaaaaagacggctgtcctatcgataaaacagaaggacagccgaattcttattattcaacgtatttattatagtcagtaccattcaccaaagttttgtcaccaacttttatagtcatttcattagtcacatctactatccctacaaatggactaacgggagtataagttcctgatttcttttgttgactggcaacagcactgaaattcaaagccgcctgttcctgcgaagtcagcaaatcagcagaacaattattgaaaataatcactctattatgggttgtattatttgccacatctccaataaacttagaaacatatcccaaattgcttgtacaatctccgttcaacgccaatgtgatattactggtatgacaatctgtaaaggttacactatcatacaaagaacctaccaaaccaccataagaaaatgatgccgcaatgttcgccgtttctaccttacaaccggttaatgtagctgttgcatctgatgtacctttgtttttttcgatgtaaccgatcaaaccgcctacacggaaagagttggtcccttcagtcaaaattttcacattcttagctatacaattggtataagttgtgccagttcctttggaatatcccaccaatgagcccacccatttgggagatttttcagcagaaggctcaatcgttaccctgtcaagcgttatatccttaattgcagcattcccatatactgctgcaaacaacccgatacaagcttcgggagtataaatggttgcttgttgatttaataaatactggctcatattcaggttagaaatcgtatgttttcctccatcaaatgttttgccgtttataaccatccccaaccaaggcttattattcaaattaatatctacacacagtttagcatcagcatctactgttacaggaagagaagcagccgttgccgaagtcggcgcttgtttagactggaaccaagccagttcggccgcacttttaatttgataaacattactctccttctgaggttgggtcttggttgttccatcccatgtatccttaatcaaggtaaaacgattgtaatctgttccttttactaaagtcgtactattaaccgtaatagttcccccatccacttgagcaggaatgaaaggactcgtagcatcagccaaagaataatgtttcgccgctgaaacagcagcatttatcacctcttgtgaagcatcttttgcgtaagtataatctgcaatatcaccataaccaaaggacttcaagttttcttcggtgaaagaaacatccacactgcaatcactatctatagtaaccgtacccaccaggttaatatctccaataaacttggacatataaccactccaaactttaggaccataaaaatcactggaaaatgctccgtattttgcactggaattttcattgacagacaacttgatattatccacatcacagttattgaacgttctatccgcacttccttgcactgttcctaccagacctccgatagagaaactaccttttattgtaacgttacttgctgaacagcctttcaatgtcactgctttatcagtaccactcatcttgccaataaatccaatcaaaccgcctatacggtaggcatccgcactgttactctcaatcttcacatttttagcatgacagttttcatacgaagttgtaccgtaagagtatcccaccaaagcaccactccattttgcatcggcaccattaccagttacttcaaagccgtctatcgtgatatttttaatctgagaacccggtttagttgccgcaaccagccctacacaggcattgggagtatatttactctgctccgaaagtacaaaattatccacccgtatattagagatggtatgatttgcgccatcaaaaacagcattttcacccaataccatgccaatccacggctgttgcttcatgtcaatatcagcacatagtgtaacatttcccgtcattgtagcaggcagatcttttccggttgttgttttaggaatttctttcgactgatagtaagccagttgtgcagccgtataaattttaccatccgtgggtgttgcttccgctacagaaacgccatcccattctgatttaaaattaaacttatcggtattactgtcgcccactttctcaacaactccagatccataggaagttactgtagtttcactggaatttccatcagccaatgatatatttttcactgtaccatatacttctacattaccgccggctatgacaagttctttcactgtcaccccttcttttatgataagagtatgatctgctgttttggcagtcacttttgcataagtggctttaccgtcaactgcatccagagtaacagtagaagcaggtaactcaatcttaaaagaaggttccgaagatacactacctgcttctacagcgggaatagccactcttacagttttggcaacagaagatccttctccttcagaagattcctttatggcaatttcattggaagcactgattttatcaaaagaaatgctgacagcctcattttccgaattactctttttaggcaatgctatttccggtgaattttcactgtccggaacgtctgctatcactatcgcattggaatttttcaatgcttcggtggctttcgctacgctttctacttccgtaggaacctcgcctattactttatcgatagcgactgtagcataaagtcttaccccacgttcagccatgactcctttaccgtcatcccctctgaatgtcttgatgctgagtgtattcttattatctcctgctactgaaatattcagttccggatatgtattgacagggatagggaagtagaattccaagtcctgaagagcatcggaagttgtaaaattaatggtaaccactttattatctgttccactcacctctgtcacattactattcgttaaagtttttaaagtgggtattccttcggcagtgaaagtaatttctacattacccgcaatatccggagcacctgttccttgagatgtcaagatagcccgtgtatatccggcagggatgtttttcaccataatatagattaaagcccctgcattcttgaatgaaacttgattttgtgcatctttacttatcaggcacgccataggtgccccgttgttatctttcggattttcagatttatacgtataagaaacaggcatatcataacttatctttgtcccatcatatgttacatcttcggaataaggatagtaagctaccttcttctctccttcacaggaacccgaaaactccgcactctgtgtacccgcctcactagaaagggtatattcattattcgcatatgaaacagaattgttcgattgggaaaatataccgattttatctccggcactccactttacagataccccatccatataagttcgtgattcgacggatggtatcgtagcaaccaatatgtcattgcctgttcttccatatccttcctcaaatgtttcatttgagcagccactcattgcaaaaataaaagcggcaaaggatagatacattatatttctcatgatgataaaattttattaattcaaaggcctgtctacataatcaggagcacttactgcaaatcctttttccacttctacttcgataacctccactttaggagcctcatacatttccatattgtttgtttccataatttccgtacaataaatttagattttaatttttcaatgattctgttcagacattatacgccccaattataccatagaatattttttatagaaagatgctataattgccgtctgtgggcagaagactcctggcggtccggtgacatatactgtgtctccgcaacctcgacttgacagataacgggaaataaggattcgcattcccgcttgcagtgttgttttcatacgtctgtaaatgttagatcagtctatcttgtcaaaagactttgcctaactccccctcctctgttcggcggttaacaataaaaaagcgtgagggctgtatcttgtttatcctatcgtcgggccttcgcattgccttgtacctagataaacaacagccacccacgccattaggtatataaatgccacagtaatggcaggtatataacacagacgtgagcgttgttgttatcatcttcaggtacagttcaaagttgcgaagtttgacgatagaagataatttcaataacgcttcttaaaatatgtaactttctactacgccatagtataatagtcggtacaaatataataatttcttaaataggaaaaacgtttcttagcgattatttttaataattgctacaacaagcattaaaaacacttctgtatttcacaataaatcgactcaacataacaccaatattaatagaaagttataagcaattatgccctcatgctctcactaagaagttaacatattgataatgaatactgaatgaatgatgatagcatatttcaaaaagtatctttgccctcatgccctcattctacagaacaaataaaaagagtatatccatctgataaccaacgacatgaacacatacgaagtcttaattcaaaagtttgtcagccatcgcattttgagctttttcatcacagtatactctattttacaaacatccgattacattttcatgctgacaagttctactcatcgtactttgatatttgttctttctattattcgcaattacttactcactagtgtgactaactctaatcacaaaggtgactaaagttaatcacaagtgtaattaagtctaatcacaaaggtgattaagcaatttcccatagtaaagaactgcaatatgaatgaccgattatcatataatgatctctatataaactatcaagaactccataaaatacagtagttaccgttgtttctcctagcaaaatatgataagattcgtgtatataaaagggatcttgtaggcattatgccacttttcttcacccaaaacggcaaaatatactcttttctcaactgagtgattttgaaacgaattcagctatatcacattgaatataaacacattatatagtaatcagtataattaaacagtgagagcatgagggcaaattgtttcttcaaaaacatgctaccatcattcatttagcgctcattataaatggattatatacataatgagagcatgagggcatatttgcttataactttctattgttacataagcgttctttgaaattaaaagttttagttacgtattcgttcataaatttagagtgtaacggtatgaaaagaatgaatatgcttacaaacagaaagtcatataggcaggtagatacaccaccccttcctttacactcaggtttttaggatgaatcacatagctccctcctatacgctgacgaaaactctcgttgaaccgggtaagagaacggatggaatatttatcattcgatttcacctctatcggaaatattttatatctcagtttgctgtggttcgacaggataaaatctatttccatgtcgttgcgatgcttctcttgattgtatcgcgtgtagaagtacagtttgtgcccggcagccaccaacatctgggcaattacgttctcgtagaacataccctcgttcaccgacagttttcccaataagatttcccgataaagctcaccgtcagaaatctcattttcatcaaatgtatgactgataagtagtcccgtatcccccatataacatttcacatatgttctgtcctcattcagcgaaagtcccacgttagggtccgagcagttaaagcattcattggcaatcatcgaatcggagagccaaaagaaagtatcatgatattttggaaagctcgcccccttttcaatgcgattcatcactacacgtctttcggaacgagaaagaaaagccggaatctggtcaaatatacttagtacactcgacctgtagccagactttatcttctttatatcattccggtacagtgtcagtatgtctcttttttccatatcggccatttcgaagctccggttgttctccagatacgccgacagacttttcggcataccgcccacaatcatgtattggcggaacagcagcatagccttggcgtgaatcccctgctccaaaggtacctttttatcaaagcattggcgaatatatgccatcaatggctcttcattcatagcccaagcaaactcctcaaagtccatggggtacataagtagtgtcctttcttcagaaggaatggtaatatcatttacattctcctttatggagattagcgagcccgtctctatatagtcgaaccgtccatctgcaaccagatactttatcgcttgccgggctttcggaaactgttgtatctcatcaaatatgataatggattcttttggataaagcctcacaccatattccgaagaaagaataaggaaaaaggtgtcgagatcattcatgtaattgttaaaggccgaaataaccgagtcactaactttgttgaaatctatcataagatagctccggtattcattctttgcgaactcttccacaagagtggatttacctatccgtcgggcgccttctatcagaagcgccttagtgcctgccgtttgctgtttccagacaagtagtttgtcatataatttacgcttgaatatcatatcattcaatgtttatcatctcatccatatgcaaatttaatgatattttctgcaatacgcaaatcaaaccccacatttactacctgcaatacgcacttttacaagatagcatttcacctgcaatgcgcataaatagatattagaatgtgagcagttaaataatatcttccaatattgacaatttcactcattcaaatatatcggctgatatcccgattttccacttgccttactatatcatccctttgtaggatgaacaatgatctgtttgccgacaactcttggtacttccgcaatgcgctgattcgtgcgaattatagaaatgtgcgaaaagaggttgaacccgatatgaggtttttgaatttgtttttcagaaatctgatgatgggagaaaatcatgagttaaagaatggctttgttgctcctctctaccctaataatcccaagcatccgcgacaaaagtatcttttgacggtaaaggggttagctattttcaattcaacaaaatgatatacaacaactaataggtatcacagagttcaatgaagagcagcccatgttacagaacattttccacatttctgctttactcctagcaacatcccattatgaaattccatgaaactttcattcaacctcctcacattcttctcactcgttccgcttcgcatcatcacctgcacccatactctcaagatactgcaattcccgttccgcaaactcacggttctcctcctctcccagcatttgatagagcagttccctagcttgcgaataatatttcaagtttactaatacttgtgctgccctgcgccgaagaaaatgataaagtggaaacaaggtattcttttcatcaccatacatctttatctgactgccaaccaaactcaccatagaataaatatactcaagagctcctgtatccttcatttcgacgagacagttggtaaaatcacgaatcgcatgaatggatgaatttcttttagcattagtcaaataataataagccttttcaaaatgccctaatgtgagataaacaaaaccgatatgataacaaatcacataatattcttccttgccacgctccggcaattctgtccagtggacttgataataccgaaaaatagaaagataacaccccaacgcctgaagataacattgctgcctgaaaaatttcttcccccaataaatagtagtctgcaaggtaggctcggtataagccagcaacgcctgttgttcctccgtcagttcgtcaaactgtttgtttgccgctttttctttagcatcgtccaacatatatttcaactcccaataatcatcatgatccgttgtcaatcttacctcaatcatactactgaatactctgcctttttgggtttcatcgaaaaaagcatctaccctgtccgtccgcatagccgacaacttataataaagagatcgttcattactgccttcagctttctccaacgcaatcaccaactgcccttcagcaagtgtgatacagatcagagcatcttttcccgcctgtcctttttcatccatcacagcatctttcaacctaaaagaaagaatagacaataattcggtacgcctctctatccgcccattgcaaaccagtgtcattccctttatatcttcctgtttcactgtaccaaaaagagaaagaatatcctctatctgatccatatcttgccgggaaacatcgacaggttccaacagcttaccatgtccaatctccaattttcgtctcaacaaagccaagcgattttcgaattcttttttcaccaacatgtcttgtattgaagcagattgttctgccaactctttaaaactacgggctatcataaaagatgactcaagcaatacccgcaaatgttgttttaactgagtttcactgcccgacaagaacagacaggcagacagacaagccgtaaaaggtgtctcactttctccatcctcatgacttttacgcaaatagcaagtccaagctgtgtatcggcagttaatgttgttaatgtcaaaaactatttttttagactgttcatagctacatgcgtaaaaatctttataatataactgaatattctgacctgttttttctcttaacaaatgaaaataacctccttgaaaaccgatgataatggcatcagcatcaattctcttcactagttcacagtgcatggactgcacgaacctgataagttcatcggtggtcatcgccgaataaatcttttcttgctgctttttcggctttgtaacaaaatgataaactgttacgaaaaccaccatcatagatacgaagacgacagaaataatcatatcttgttacagttaatctttgtatgtctgtaaaaatacaaaattaatcgggaaatgttagaagtgataggatattttaatgaattcccctaagaagctacttaaaaatccggttcaatcaattccttccgatgcatccggtgccacctccacaaaatcataagacatagaggaaattccattggagatattctgaaatacctaaaaatagggattgtccatatccatattttcatcgaactttgcaaccccaaaaaacgaacaaatgaagatactttatataatactgtttatacaaataggatggatatttcccctctccgcacaaaaacaagattccatttatatcggaacgcgtcatacattgttttctgaaatactgaatgaagaaagaaaatattggatttatgtacctgagaccaaagctggtgaaaaaggaaaggcttatccggttctttatctattggatggagattccttctttcattccgtggttggttttacgcgtttcttctcttcttctaaaacctcaaacttgcctccttgcatcgttgtggctgttttaaacacagaccggaccagagatttcactcctacttgctcagccgcccgccgggatggtaccatttgtccctatgataagccggcaggtggtagagctgaacagttccatcgctttctgatagaggaactacgtctggaagtggaaaataaagttcctgccaacggtacaaactttcttgtcggacattcatacgcaggtttatttaccctacagacactgtcaaatcatcccgagtcttttgactcgtatatagcaatagatccaagtttatggtgggaccgaggagtctttctacaacaagcagcaaagaatgtttatcaaaaagacttctccggcaaacatttgtatgttgctttcgccacccgccaacgtcctgcaatcaaacttatccagttttcattggccgacagcttaaaaaataagatcatccctgaaatgaaaaacaagcatttgcatgtcgtttataaaaaatttcccgacgaggtgcatggcaccattgctcttcctgccattttcgatggattaaaatctctatttcataacactatttcaaccaaagaggcaacatgataatttcttgcagtattcggtttctcatctgttacaaatacgctccggtttactattggtaaaaataacataactgatgcctatattgtagccactcgctcaattccggggtattgcacggctataattctcacatccccttctgtttaacatcaatttaagatttcaaattctatacttatcattttctagaataacagattgagacattgtatcaaccttggctacagatttatgctattctttccggaaatcatgtaattagggttataacatctgtaatttatctacactgtattttcagtcatgtacttatctttgcatcaagattctggaattcaaaacttaataaaatcaagtgataatgaaacgtataccagtcatcatgattgcaagtttatttgttataggaatacctgccataacacagtccgatccggttcccaagaaaaatggtaataagtatgtgctttacgaaaaacgtacagataacggggcggtctgtcacctatttcaagcgcaacaagcgaatggatgtttggaaaaaccgatggtaaagggtacactgtttcgctgtggtgtatggcacatggaagaaatcaaaggaaacccgaaatcacaagaggcatacaaaacgagtaaacaagtataggaaaaaagaatattatgacattagatgattttttgaatcatattgaagccggcggtgcactcaatacaccggaaatctatcggctgatggatgaaatgagcgatgaagcccggcgcgttacctgtgagataaacaactcgtaccattcacaagaagaattgcgtgcgttcatgtcgcgcctgaccggtaaacctgtggacgaaacattcaagatgtttcctccgttctacacagacttcggcaagaatattaccatcgggcgtcgtgtctttatcaatgccggttgccacttccaggatcatggcggtgtgacgttgggtgacggctgtcttatcgggcataatgtggtctttgccacgctcaatcacggtacggctcccgaagaccgcggggcgatgtatccggcgcctatccggttaggcaaaaatgtatgggtaggttccaactccaccatcctgcggggtgtgaccgtgggtgacaacgccattatcgccgccggatctgtggtgacgaaagacgtagcggccaacacggttgtaggaggtgtaccggcaaggcatatccgagatatcgacaggaacgaaaagtgatagcctatggaatcggaatcactaaccaaccatactgccatccttgtcagatccatccgaacggtacaccatactgaacgggttgtgcggattggttctaccgggcattacactgaccaactttccggagttctcgttgtattcccttcttccggttgaaacgacgagtgccatgcctactgccggagtcggccgtatcataatctgcaatacatctttatcgacggcagattttgcacaagactcttgctactgtccgatatcggtttctccatcatcatcaccaatgcggcaagaaaaagaggctgattttcctgatctgcttgaagtgggaacgttggatgagatgcatgtaaaataatgtctgtaattgaggttatacaatcagtaatccatctaccggcttttcctgtaatccgctgtaattttgcactatgaaaagaaaacaagaaacaataaaaatttaaattacatcggttatgaaacgtacaactattttaatggctgctttcctctgcctcttcagcctgacggaaagcccggcacaaaacactcacaaaaatatggaacagttaaatctgacacaggaatgggacaagacgttcccgaagagcgacaaggtgaaccatagcaaagtgactttcgtaaatcgttacggcatcacgctcgctgccgacctgtatgcaccgaaaacgattttcggaggtaagctgcctgctattgctgtcagcggtccgtttggagctgtaaaggaacagtcgtcggggctgtatgcccagacattggccgaacgaggattcctgacgattgctttcgatccttcgtttaccggtgaaagcggtggacagcctcgcagcgtagcttcgccagacatcaacaccgaagacttctcggcggcggtggattacctcgcgacacgtccggatgtggatgccgaacgaatcggcatcattggcatttgtggttggggtggttttgctatcaatgcggctgccaacgacacacgtatcaaggcaacggtagcttccacaatgtacgacattagccgctgtacagcaaacggttacttcgatgccgctgacaatgcagatgcacgctacaaaatgcgtcaggagtttaacgcccagcgcacggaagactaccgtactgacacttatccccgcaccgtgatgaatccggagcctgccggtaatgcaccgcagttcatgaaggattattacgattattacaaaaccgaacggggttatcatcctcgttccatcaactccggtttgggctggaacaaaacctccaatcttgcatttctcaacgcacctatccttgcgtatgccgatgaaatccgcagtgccgtgttgctcattcatggagaaaaagctcactcccgctattttagtgaggatactttcaagaagctgaaagacgataataaagaactgatgattattcccgatgccgtacatacggatttatatgaccggacagacattattccattcgataagctggaggaatttttcaaagaatacttaaaatagaaggcttcaagaaaaagaatgggatagcgcagaaagcgaaaatatattgccgatgtgggtggctgacatggatttccgtacagcccccactatcgtcgatgctttacgccgacgggtgaaacacggtattttcagttatacccgtgtgcccgacagttactacgaggctgttacaggctggttcgcacgtcgtcacggttggacgattgaccgtgaatggataatttacacatcgggcgtagtcccagccatctcggcagtcatcaaggctttgaccgttccgggagataaggtattggtgcagaccccagtctataattgtttcttttcttcaatccgtaacaatgggtgtgaaatggtatcatcaccgttggtttttgcaagtaatacttccaccatcgattatgaagatttagagcgtaagactggtaatccgaaagtgaaggtgatgctgctgtgcaatcctcacaatcctgccggaagggtgtggaaacgtgaagaactggtacgtattggtgaaaatagaacgcaactatatactttaccataccaagcattacgtataacaaagtaaatagttgcgacttaattttttatctcattttttcttttcttccataactgccaactattgattatattctgccataccacataactacccggaccgacagacgataaaggattaagatacgtaaccgccatccaaatagctagtactgtatttttttgccccaatgcctgtcctgcacttatacggtcattatatgcactaccaattcttttaccaaaataaaattgtaagcaacaagttactaaaccggcaaaagcaatcaacatctctaccgttacatcagcagtactgttaaccaaagagcgagtagtctgccccattacaatggtcaatgctaccgcccataaataaaaagccgaagtatgatatttcagtaaaaacttgtggagccggggaatataataacggaataataaagcgataaaaaacggtgcaagcaacaatggaaaaaccttacttaaaatcttaagaaaagcaataccaaaagtaacatctgtatgtggttcaaccaatggaaatatcaaaggaactgctattgcagccaaaatatttgaaagcaatgtataagtagtcaaactggaagcacttccacctagttttcccgtaattactgccgctgccgtagcagtaggacaaataagacaaaccatagccgcctcgaatatctccttataagattcatccatcggacaaaatattaacaacaacgcaataataccacaagaaatggcttgaatagccaacaaccagccatgccatactctaggaaccaactcttttggttcaattttacagaatgtaagcaacaattgggcaaaaatcaaggaaggagttaaaaaagaaatcaacccattcataaatggctttgtcggctccagaaaagtgaagttggcaaaaacaaaataaccgataactcctgcaagcatcgctagaggtaacgtccaattcttcataaacttaaacaagtccatctttcaatatttattttagaatacaaaataaaagaatttagtccaaacactcgtctatttttcgggttttgtggcaagtttcgaataaaaaacgcaaaacttaaagacaaaagccgagttttcactaaaaatcgctacatttgcaacttaattgatatgaaaaccgatagacttaaaataatattcctgttgtgtagcctgtggctggtctttccctgtttctgcctggcggcaaagggaaaggactttgtagtcgtcattgatcccggtcatggcggacatgatcccggtgctatcggcagacgtggaaaagaaaaaaacatcaatctgaacgtagctttaaaagtaggacaactgatccgaaataactgtaatgacgtaaaggtaatatatacccggaaaacagatgtctttatccctttggatcgtcgtgcacaaatagccaataatgccaaggccgatttattcatctctatacatactaattccatagcccgtggcagaactgtacggggagcagagacttatacgttaggactccaccgtactgaagaaaatttagaagttgctaaaaaagagaactcggttattttgatagaggataattatgaacaacgttatgccggattcaatccaaattcttctgaaagctatattatttttgaatttgtacaagacaaaaatatggagaagagtgtaaaattagccactcttatccaaaaacaattcaagaatacagccaaacgaatagacaaaggagtacatcaagccggattcctagttctacgtgccacttccatgcctagtgttttggttgaattaggctatatctcaacaccggatgaagaacaatatcttttatccgatgcaggcactacggcgttatctaacagcatttataaagcattcctcaattacaagcgcgaacatgacgcccccatcggccgcagcagagtacaagaacaagaattaccggaaccagaaaacaaaccgaaagaatcaagaatagaaatacaaactgcggaaccggacactgcaacggaaccggacaagattaccaaaaagcctgtgcctgccacacaaaaaaagatcacaggcgaccaagcccgaacatctgccaagcctgtatttaaaatacaaatattggtatcaaacaaaatattgcccaaaggaagtaaacaactgaaaggtgtatcacctgttagctattaccgcgaaaaaggactttataaatatacttacggagaaaatacggattataataaaatactacgcatgaaacgtaatattactcctaaatttaaggacgctttcattatcgctttcaaaaacggagagaaaatgaatgtgaacgaagccatcaaagaatttaaaaagaatagataatataaaaggtataattgaaatgacgaaagaggtaaaaataggattaataggcatcgctgcattggctatgctgatctttggtatcaactacctgaaaggaataaatatgttccaatctgccaattactattatgtagaatatacaaatataaacggattagccggatcaagccccgtctttgccaatggttataaagtaggtacagtaagaaatatcaattacaactatgcaaaaccgggacatgtcacagtagaagtggaagtggacaaggaaatgcgtatccccaaaggaagtacaggagaactggttacagaaatgctgggaacggtaaagatgaacttactccttaactttaattctacagaatactatcaaccgggagataccctgcccggcaaaacgaatgcggggctcatgggagccgctgaagaaaagctagttcctcaaatagagcagatgttacccaaaatggattctatcctatattcattaaataaaatattagctgatcctgcattgagtgcaaccttgcacaacgcagaaaaactgacagccaatctggatgtgacaacacgtcaattaaacatgttaatgcaaaaggatcttccgcaacttactggaaaattaaacacaattgctgataacttcattgctatcagcgacaatttgaaaggtattgattatgcttcaacgttcaataaaatagactccactttatataatgtacaaatgctgacagaaaaactcaatcgcaaggacaacagtatcggattgctattcaatgatcctactttctaccaaaatttgagtgcgacgacagcaaacgctgcaaccttattggaggatttgaaagcgcatcctaaacgttatgtacatttctctttgtttggcaagaaagataagtaacatatttgctaatttaaaaatattctaaataagtctactcaaccatttttccacttattttcagtaaatgactgcaaatagggaagaaataccatgtagacttatttcatttaaaataaataaaagcctattttgactgttagtcagctaagaatcagtcaattatcaaacaacaagaatctttcaaaagcctttagatagaggtttttataagtaactgaaactaaagatattactctttaaaaataaaaagcaagaaaaaagcgatttgttttttcagaaattcatttcgaaatttgcattgtagaagtttcgctttttataataaatgtttcatatgattgaaaacgatcacgtcgttttatggggtcgttgcctgaaccttatcagagacaacgtaccagaaacgacctttaaaacgtggtttgagcctatcgtaccgcttaaatatgaggacaaggcactgacaattggcgtccccagcccattcttctatgaatttctagaagaaaagtttgtggacttgctgcgcgctgccctatataaagaaattggggaaggaacgcagcttatgtattgtatcttgaccgataagaccaaccatataactgttaacatggagggaagcaaacgctcttcagcactacccacacaaacagttatacgagatggtaacaaggcacctaatccaatgcaggcaccggctccgcaggatttagacccacatttgaatccaaattacaattttgagaatttcataaaaggaaatagtaatgagttctcacgtacagtaggagaaactgtagctaaaaatccggcaaaaacattcaaccctttgtttttgtatggaccatccggtgtgggcaaaactcacttgactaatgctattggtacccgcatcaaggaattatatcctgaaaaaagagtattgtacgtatcagcacatctgtttcaggtgcaatacactgactctgttcgtaccaatcatttcaatgatttcattagtttttatcaaaccatagacgttttgattattgatgatattcaagaattcgccggagtaaccaaaacccagaacacattcttccacatctttaaccatctgcaccagaacggtaagcaacttattctgacttctgaccgtgcgccggtaatgctacaaggtatggaagaacgccttctgacccgctttaaatggggcttagtggccgaattggaaaagccggacgtagaattgagaaagaatatcttacgtaataaaatacgtcgtgacggtttgaatataccggaaacagtaattaattatattgctgaaaacgtaaatgaaagtgtacgtgaattagagggcatcattaattcacttttggcacaatccattattttcaagcgtgatgttgatttggatttggctgaaagaattgtacgaaaagctgtacgctgttgtgagagcaagcctgtcacagtagaagatatcatacagaaagtatgcagccattacgagatagaagaatctgccatccatactaaaacaagaaaaagagaagtggtacaagtacgtcaggtagctatgtatctggccaaaaaacatacagactcctcttcttccaaaattggtcaattaataggtaataaagatcatgcaaccgtattgcacgcttgcaaaatagtaaaagaccaagtagaggttgacaaagcatttaaagcggatattgaggaaattgaagcttctctcaaaaggaaatagaataaaaccacagaggtgcgcaaagggcattttctttatttccctctgcgcacctctgttttaagattgatagtttccggcaattcacttctcaaaaccctgtttcttcaaggtttctttcaaagttacagacatacattcattatccgacttcttgtatctgacctcagcaaatacctgagccagtgtttccttatgattttctttaataaactgatgattttccggaagtgactctttatatctataaatacgatcaatatcctctttggtataatcatgatacaattcttcatgcaaaataccctctataggaagacgatcgacttgtggagggcattcatccggatatcctactgtaatagtagccaccggcataaccaattccggcaactgaaggatatcaataatttgatcaggattataaatcgttgttcccaaaaaacaaatacctaatccattttcctcagccaatgtacaaaagttctgagtcacaagcaatgcatccgtagcagcattcaaaaaagaaatgggattgtcataacccggtaccgccttacgctctctgcaccatttactaaaacggttaaaatccgcacaaaaagtcagtacaaccggagcacctgttaccatcggttgattaaaatgggcaggtgccaatctctctttcatctgcttgtcacgagtcacaatcacactatataattgcatattacccattgtagaagcacggaacgccttttcaagcaaatcatttaacaaagaagcagaaatatcttcctgcttatatttacggatcgtccgtctattatttatcgattccatatatatttttcttgcaaagataaaaaaagaaaagagtaataatgcattttttgcaaaatattatatgctaagaatctggccttttcaactagtcaatcactcatcccctccatcaaaattttcaaaacagaaaacttctacaaataagcaagcatatatatcttttgataatcaataaattaacaaatattcttggataactttcaatttgttgaaaacttatctgctttttattttgttaattgaaaaaacatatatagctttgccgaaacttttattataatgagttgtaacttctacactaaaacaacttattgatattacagtaaatctaaaaataaaagtggaaagacaaacgtacacctatgacgaagcttttgaagcatctttacaatacttcaaaggtgatgaacttgctgcaagggtttgggtaaacaaatatgcagtaaaagattctttcgggaacattttcgaaaagtctcccgaagatatgcattggcgcattgcaaatgaagtagcccgcattgaagctaaatataagaacgggttaaacgcacagcagctttacgaattattggatcactttaaatacattgttccgcaaggtagccctatgacaggtatcgggaacgactttcaagtggcttccttatcaaactgctttgtcattggaattgatggagcagccgactcatacggaggtataatccgcattgatgaagaacaagtacaattaatgaaacgtcgtggtggcgtaggacatgatttatctcatatacgaccaaaaggttctccggttaaaaattcagcactgacttccaccggactggtgcccttcatggaacgttattccaattcaacacgtgaagtagcgcaagacggacgtcgtggtgctttaatgttaagcgtatccatcaagcatccagattcagaagcatttattgatgccaaaatgaccgaaggcaaagtaaccggtgctaatgtatccgtgaaactagatgatgcatttatgcaggcagctgtaaatggcactccttacaaacaacaatacccggtagattccgatcaacctgttttcacgaaagacattgatgcatctgcgttatggaaaaagattgtccataacgcatggaagtctgctgaacccggtgtattattttgggacaccatcatccgtgaatccgtaccagactgttatgccgatttaggatatcgtactgtttctaccaatccttgtggtgaaatccccctgtgtccctacgattcttgtcgcttattagctatcaacttatactcatacgtagtaaacccttatacaaaggaggcttactttgatttcgacttattcaaaaagcatgtggcattggcccagcgcattatggatgacatcattgacttggaattggaaaaaatcgagaaaatcatagctaaaatcgattccgatcccgaaagtgaggaagtaaaagaagcagagaaacatttatgggaaaaaatttataaaaagagcggacagggaagacgtacaggcgtaggtatcacagctgaaggggatatgcttgccgctatggggttacgctacggaacagaagaagcaacagagttttctgaacaagtacataaaacaatcgctctggaagcctatcgttcatctgttaacatggcaaaagaacgtggagcattcgctatctatgacagtgaacgagaaaaaaacaatccgttcatcaaccgcttaaaagaagctgatccagaattatatgaggagatgaaaaaatacggacgacgtaatatcgcctgcctgaccatagctcccaccggaactaccagcctaatgacccaaactacttccggcatagagccggtgtttatgccggtgtataaacgtagaagaaaagtcaatccgaatgatcctcagacacacgtagattttgtagatgaaacaggagatgcatttgaggaatatattgtattccaccataaatttgtggaatggatgacagtaaacggttacgatcccaccaagcgttatacacaagaagaaattgacaaattggtagaaaagtcaccttattataaagccacatcaaatgatgtagactggctgatgaaagtaaaaatgcaaggacgcatccaaaaatgggttgaccattcaatcagcgtaactatcaatttgcccaatgacgtagatgaagcattggtaaaccgcttgtatgtagaggcatggcgttcaggatgcaaaggatgtaccgtttatcgtgatggctcccgctccggagttttactttctaccaaaaaggacaagaaagacaaaaaagaagaacttcccccttgcaaaccacctacggtagtagaagtgcgccccaaagtactggaagcggaagtagtacgtttccaaaacaacaaagaaaaatgggttgcatttgtaggcttgttggatggacatccatacgaaatctttaccggtctgcaagatgatgaagaaggtatttcattgcccaaatcggtcactaccggacgcatcatcaaaaacattgatgaagaaggcaacaaacgatatgatttccagtttgaaaacaaacgtggatacaaaacaaccattgaaggtttgtctgaaaagttcaacaaagaatattggaactatgctaaattgatttcgggtgtacttcgttggagaatgcctattgatcgtgttatcaaactggtagattctctgcaacttgacagtgaaaacattaacacatggaaaaatggtgtagaacgagcactgaaaaaatatgtaacagatggtactagtgccgaaggacaaaaatgtcccaattgcggaaatgaaactctcgtatatcaagaaggatgcttgatctgcaagacttgtggcacatcgagatgtggataatggtttattatataatgtaacaacacaaaggaaaagctccttcatgactttcgtgaaggagcttttttatataaacaaaataaatcccttttctatcttacccctacaatacgatgaaaccgttccacaatacgccttcctaaatccatacgcgtactatctactttatgaatggcagcaggagtcacatcatctttatatttggctttacctacacgtattttcatcttatccagattaccggaaatattcactccagccttaaaaggcaaaggcgatttcaaaatggatatatgatatttaaaattcatatccagtccttgctctccccctatggcagctttataacgatctatagacacttgaaatggataaacaagaacactaccgtcattaacaactacattaaccgaaatactatcaaatacattcttctttttatttttaaacatcaacatctttgaaatttcggcaaaggtctcaccatccatcaacaccaaactgtccccttttatatacatggccgaacgcaaagtaggtatacgaatattcatatttgaatccagacgtgcctctgcagccacatcaaactgaacccttccttcaaaagatctcagcataggtacaatggtatccattgaaggtataaaatctaccagcttagctatatttatatccctaattttaaagtcaaagcctgtatatcctcctctgactgaatccgcacgatataccataaccgccttcatatcagcatccaatgcacgcatttccaaatttcttaaatataatgtacgatttttcaaatctacctttccacacacatcttcaaattccaccttttcaaacactacttttttcaaatctgtctgtaattcaaaatccaaattacccggtaacacaaacagcttcatttctgttggagacactgtgtctgtcaccgccacagatactgaatcttcagataaagagaatgaatttatcaattgattacaatcaatcatctcagaagagattgctaaacgcgcttttaaagtttcatttttagtcatcgcacgatataatcccattacctcaccggtagcaaccatatctgaatgccctattttcaaagaggcatttcttaatgttattttcggaccatctactgttacagctgtcttacgtactcgtaaaggtaaaccaaattcaggagtatgtaccaacaacctatcaaaaccaacaatcccccgaggtatccataacgaatcatttttcttttccaatttcgccttaatacctgccacgcctaacgccaacttcgtttcattggcattaaagaaaagagaatccgtacgcatggaaaagctaatcatcggcatcgccgaattttgttccttcggagcaagttcgccagttccagcagtcttgccactatatattttaagcgaatctcctatattcgcacgcaatttattcatttccaattcacattgcaaagtgacaatctttgtggtatcttgaggattggttgaaacaaccttcgctttcatccgatctatctctgaaacaaatttcctactattcaatattatttctctgatatccaattcggcctgcaaagtttcactatcactgaattttaaatcggcattacctaaaaaattaaaatctttagcagtgtcttttaactcaaaatcctttaaagccaatcttccccctaacctgatacgtccaatatcctgctttttcaaagaagaaagacgacattttaaatttaaacccgcatctaatttaccacggatggttacattttcctgcaaagggaaagttttagctaaagcatccaagtcaactgtagattcagtatgaagtgttataagtggatctaccaataaatcctccactttggcatctgctagaatcttggtatgtgctccctcaaaatgaagaattttcaagttcaaaaatgaaggattgcgacgcatcaaatcaatatacgattcaaaatcagccgtaaaattatcaataccataaggaagtccttcatatcgggcggatgcatcattaatctttatattcaatgataccgccggaagctgtttgtttccataattaccttccaatgttccatcaaccttaacctcaccttttgccgaaatttgtccacgtttcacataagcctcgggaatcatattcatgactgtttccatggaaggtgcatgtagtccatatttcaagttcacacccaccatcttggtaactgtatcacgttttaattcaccgtttacatccagccggataccatttatagtcaatcctgtatttttcaatgtccacaatgccgtagacctgtctatctcaatatcagtctgcaaggaagccgctaccttattaatcaataattcaccttgctgccaaaaaagaatatttttattttcaaattctactcccaatgaagaaattccttttgtcaacgccagctttaggcgcaaatcaacatcatctatacgtgaataaacctctgtattacgatcatcaaaaatcaaattggcatgttctaactcaacctgacggatatctatctcgctatcaaatttattttgtgaaattgtatctttttccacagccaatgtatccgaggaagttttcactatctcccaattcgccttacctgctttatttcgataagcataaacagcaacatttttcaaagacaaattatagacactgatcttatttttcaaaaaataatccaaaggattcactatcaacacacattctttaaacgccaataaagaatcggtcttttgtggaagactatcattcaatactttagaaaccaagaaaccttcgtcaacttttaacccaaattgaggaaaggtagaaaagaaagtcaattctacactttctaccttcaaatcagcatccaatgaacgattagcaacattcaacactatcggagttaatttatctggtgtaaatacatagttaatcacaaaagccactaccacaaacccagtaaacagcaaggctcccactgtaatggcacttacccttattaatttacgaattcttctttccatattatgcaaaattaatgaaaacacccatgccatcaactttatttcgtgttaatactataaaatagaccaataaaacagataaaaaagaaaacaagaacaatgatttttaattttgagatatgaagcgaaagttctacttttgtttctcaaactgaaaaaatatgaaagcaacatctatgtatatttatctggaaggtgccaagtttttcgctcaccacggagtcgatccacaagaaacaatagtaggagctaattttataattgatttaagactaagaaccgattttacccatgcagcacaaactgacgaactgaaaggtaccgtaagttatgctgatatatatgcagtcgtcaaaaaagagatgaaaactccatccaaacttttagagcatgtctgtgaacgcatagggcaaagactgtttaatgattttccaactattcaggaaataatcatccggttgtcaaaagaaaatccgcctatgggcagtgattgcagaaatgttggagtagaagtacattatacacgatgaaaaaaattatctgacaaacatccagtcatttaattaagttcaccctattacatgccctcctcttaaaaacgtaaatatgctatcgtgcaaataacaacacaaaccaataataatgaatatacagaccatgttcatgaccctacttattaaaataaagaaagttgttttcttccttcagaatgataaaatttcatggtagcactgattcctaatgtttctattctgcgataaaaaacctcattcaaatagggagcattaggagaaatgcattcagaacggtcttcaaaataagtttgatatcgcttggccatctttggaaaaatccgctctaccctatcataaaaataatcacgggagccccgtcttaaagttaccccgaacaaaggaagcacataggacgctcctgcttcggcagccttctctactatttcctcaatatcttctatagaatcgtttataaaaggcaaaacaggcatcaatgccactcctgtatatataccccgatcggacaatatcttcatcgccttaaaacgctcggaagataccggtgcattaggctccagtttgcgcgccatctcgtcatccgctgtagtgatagtaaaactaacggcagcataagtgcgccctatatcctgcaatacatcggcatcacgagtcacaagactactctttgttatcacatgaacaggaaaacgatgtttggcaataagttccaacgcacctccagtcagcttcatctgtttttccaacggcatataaggatcattcattgaacctgtgccaatggttgcttttccacgtttcgttcccagttcatgatccagtaattccaaagcattcttctttacaaagatatgagaaatatcaccaacaccatagcaagaactacgtgtatcacaataaatgcaaccatgttggcaccctctatacaagttcatgttataagcaattccccaataattatctttacttttcaaacgtgacagaatagactttgtttcaatagattttacctcatgaacattcattttacagctccttttcttttttgatcaaatttcatcaaacaaagatacaggaataatgctataaaaagaaatataaagagaagcaatttaaaaaagtttcaactgggaaaaatgttttttgcccaacaaataatatttcataacaatgctaaaatgagtccgttccggaattatctcatctgtagacttcatcatattttctatacgagaagcggcaaaagaatatcttatatcctcaaattctctccgcgcctgcattacagcacgcgcattcgctctatcctttttcagataaaaaacaagggcagccactctatccagtataccacgtataaaaagtacatgttccaattccttatccggcaaattcttataaagcatcaacagattatttctgaaattcaaaaaagtctttctcggattctcttttttcaacgtagcccctcctacatgatataccacactttgcggaatacagacaagcttttttcccctactgcgcaaacgccagcacaggtctatttcttccatgtgggcaaaaaaatgaccatccaaacctccaacttcacgataatcagccaaccggataaaaagagcagctcccgtaacccacatcacctccgttatcgtatcatattgtccgcaatccttctcaacaacatcaaaaatacgtcctctgcaaaaaggatatccataccggtcgataaatccccccgacgctccggcatattcaaaatattccttattatgccaacttaataatttaggttggcaggcaactgttccggaatgggtgtccatataatccagcaaaggttccaaccaatgcggagtaacctccacatcactattcagtaaaactacatattctgcatcaacttgctccaaagcccggttatatccttcggcaaaaccataattctgatccagctcaatcaaacggactacaggaaattcagaacgaagcatttcaagcgacccatcagaggacgcattatcagccacacatatttcaatcccctctcctactgaattatccataacagaaggtataaacttacggagcatatccaccccattccaattcaatataacaacagacacccttttcatttcttttcagactaataccaaatgtatggaataattcagactaaaacacccttcaacgctgtaccctcttcattaaagcctcccattcttacacgaatcaactgattatccaattgatcatcgtgatccatctccacccggatgtaattatcagtaaatccatgcataggagttccagccttagatttttccattaatacccaagcttcccttcctatatgagaggtatagaacgcctttgtcttcgcatcagataaagccaacaatctctggctacggcgatgcttctcctcaggactcaccacatactctattttcaaggcctgcgtaccgggacgttccgaataactgaaaacatgtaactgcgtcacatcaagcccttcaataaaacgataagcatcttcaaaatattcctctgtttcaccacgtgttcccacaattacatccacgccaataaacgcatccggcatgatttccttaattttgcgtatcttggaagcaaacaatgcagtatcatatcgacgtctcatcaatttcaacacatcatcgcttcccgactgcaaaggaatatgaaaatgcggcatgaatgcacgtgaacgtgacacatattctattatttcatccgtcagcaagttgggttcaatagacgagatacgataacgttcaatccctgccacctgatctaaagcctttaccagatcaaagaaactttcaccggttgtcttcccgaagtctccaatattcaccccggtaattacaatttccttccctccttcagctgcggcctgccgcgcctgttccacaatctcttcaatacgtccgttccggctacgcccacgagcaaacggaattgtacaataagaacagaaataatcgcaaccatcctgcactttcagaaaataacgagtgcggtcacccctagaacacgaaggtgaaaaactacgtatgtcttttgcagctgtcgtaatcgcctcaccttgaggatgcttttccaaatttccgagataattcatcaactctcccttttgttcagctcctaaaacaacatccaccccttctatattagccacctggtcaggttttaactgggcataacatcccgtcactactacataggcacccggatgctgtttaaccaaacgatggatggcctgacggcatttcttatccgcaacctcggttacagagcaagtattaataacacaaatatcagctttctcacccttacgtgctgtacgtatacctgcttctttcagtgttttaccgatggttgaagtttctgaaaagtttaatttgcagcctaatgtataataaacagccgttttatcctggaaaattgtcgtatcaatcatacctttttatctaattagcgagcaaaggtacatattattctgcttaaattttttagaataccaataattatgcttatttttgcacattacatcaaaaattgtgcaatgataaaagaaaactttatcaagctatatgagaatagcttcaaagaaaactgggatcttccctgttacacagattatggtgaagataccacgtttacatacggacaagtagcggaagaaatagctaagatacacttgttattccaatattgcagcctgcgccgtggtgataaaatatctattataggtaagaatacttcccgttggtgtatcgcttatttggcaactgttacatacggagctattgtagttcctattctacaagacttcaagccgaatgatgtccatcatattgtaaatcattccgaatccacattcctgtttaccagcgataatatttgggaaaatttggaagaagaagcattaagtggattacgcgctgtattttctctaacagatttcagatgcctgcatcaacgtgacggtgaaactgtccaaaaattcatgaaaaatatggatgcagcaatgaaaaagaatttccccaaaggcttctataaggaaaatatcaattatacagaactctccaatgagaaggtcatgttactgaattatacctcaggaactaccggattcagtaagggagtaatgattacgggcaataatctggcaggaaacgttaccttcggtatccgtacagaacttttaaagaaaggagaaaaggtactttccttccttcccttggcccatgcatacggatgtgcttttgattttctaaccgctactgctgtcggcacacatgtcaccttattaggcaagacaccttctcccaaaatattgatgaaagcttttgaggaagtaaaacccaaccttattattacagtaccattagttatagaaaaaatttataagaatgtaattcagccgctcatcaacaaacgcagcatgaaatgggcgcttaacatacctttactagacaaccagatttatgcacagattcgcaaaaaactgattgacgcattaggcggacgttttaaagaagtcattatcggtggagctgccatgaatccggaagtcaccgattttttccacaaaataaaatttccgttcaccatcggttacggcatgaccgaatgcgccccactgatcagttatgctccatggaatgaatttatacctggttctgccggaaagatactggatatcatgaaagtccgtatcgactcggatgatccttataacataaccggagaaatacaggtatgtggtgaaaacgtaatgaaaggttattataagaatgaagaagctacccgtgaggtatttactgaagatggttggttgaaaacaggcgatttaggtacaatagatgctaacggattcatttatataagaggccgtagtaaaaccatgatcttgagttctaatggacagaatatttttcctgaagagatagaatccaagctaaataatatgccattcgttctagaaagtttaatcatagagcgcaacaagaaactggtagctttagtatatcctgattatgaaagtctggacagtctgggactcaatacccccgaaaacctaaaaacagtaatggatgaaaacttgaagaatctgaataaactggtaggaaactatgaacaagtgagtaaaatacaactttatcccacagagttcgaaaaaactcccaaaaaaagcatcaagcgattcttatataacagtattaccgaagaataaatatgttgtaaaacatgctactaatcagcaaaataggttgtataacataaaaaattagaaaaaaagttgttctttttggtacaacgtattaaaaaagtgtatacctttgcatcgttttaagaaagcaacattagtattacagatttaaaaagcaaagaaaatgaaaaaattagtatttttgttcgtagccttcgcagctgtttctttcgcatcttgcggaaacaaagctgctaacaacaacgcagaagcaactgattcagttgcagtagtagaagaagctgctgttgtagaagaagttgtagcagattcagctgcttgtgactctacagctgcttgctgtgactctactaaggctgaataattcagtacgaactctagagagaattgaaagtctgccgtgcgaaagcacaacagactttttttatgtttttacctctccctttctgccagcattccattgctttacaatacaaattatctacttttgtttctcgaaccacaaacaaaagcagaatatgaaaaagacaaatctaaaagagaaacttcaaaactggaagttgggaaattatttccgcgaattatcaattgtcactgccggagtatttatcactcttgccggaactgattttataaacagtgcctcacaagagaagcagataaataaaagtatgcaaatgataaaaatggaattagaagagaatttaaaaagtatcaatcaggccgaagccgcatatttaaatgaaattaatttcttccgattgttaatacaaaaacaggattcacttcaaaccattaaagcttctattttagaaaacaatgccaatgctccttttgcgtatgaaaattgtgagtattcggaagattgtaccttgcaaatttacacacctcatttttatgtaatttaatatatcccacttttagcaggatattactttacagttgttaactcttttaaagtgtccgtatcttcactccgattgctaaaaattgttttcctgttttccatccgatagctgtttcttgacagttgtataatctcacaacagtagagcagtctgtcaagcaatgccgctgcgacagcttcctctcccggtattgccagccactctgtaagggagtagttggctgtaacgataagcgatgtcttttcctgaaactcattcaccagtttgaacagcaacatgatatcttctcttttcaagggaaagagtgtggcattgtcaatggccagcagctgtgccttcatgatccgtttgtaggttttcatcgcatgcctggaaacatcccttgtcttcagacaggtcagaaggtcctccagcgtaaccatatatgccctgtatccggctttcaccgcctcatggacaagtccggcggcaatataggtctttcctgttccggaaccgcctgccagaagcaggttgtatgcctgtcccacccataccagctcgcgcagttcgcgcagctttctggagtcgattccttccgtccgggtaaagtcgtaacggtccagatcatgccttgcaggaagcccggccgctttcaaacggcacaaatatttccggttctccctggtccggacctcctccctgaggcaggcgagtagaaactccggataggtcagctgcttttcctgggcctgatgcagcagttcctccagatgttcggtcagattgcccagcttgagcatacgtgcacattccatgagttccttcttatgtcttgtcataatccctgagtatttcgttataagactgtatcaatccgccttgtcggggcaggcgatcctccagtccgtatatttctgttccattttcctttcccctgcacacatattcacacaggcttttaaccgagtccccgttatagatgcctttgtccagacatatccgtatggcctctatcagtgtattcttgtcatatccgggaattatgcgcaggatcacctccagattatccctgtaataacgttccttcctccttttcagattatccatccacatggccacctccctgttgcccgacacatggacaaggatgcgttcggctatcttcactccggcgtttctcggttttctgtgggagtcgtcataaacggtccttccctttctggtacagagcgcatgccggcagatgagtttccccgtatccttgttgtacagctccacattcccttccgtttcctgcagccagacggttgtttgcccgctccggtaagttccgcatggcaggctgtaataattccccctgtactgcactgtattgtccttgcggacatggtattccctcatctcctcctgcggtggttgtggcgtcccatgatagggcatgagaaagcctttctccacggcaaactcttcccggggaacaagacgggtggtcccgtgcaccttcccgttccccgtcctttcaagccattcgagggcctccctgttcagactgtcaatatcacggaacacacgtgccaccagaaagttctccttcacatatttcactacgttctcgaccttgccttttgactcgggatcggccttatggcagaacaccggctggaaatgctgctccctgacgaacgtctggaacttccttgtcagcaccaggtcccccaggttctcccgggaaatcagcaccctgtcctggtcatagacaatcttttcgggcttgcccccgaaatactcaaaggcgcgctcgtgtgcatagatggcgagctccgtgtcgaaagggcgacggctgaaacaggcgaacttgtaacgtgaacgcgccaggacgatcgcaaaaaaatagaccttcgtgcttctgccgtttcccgctgacatccatttctccccgaaatccgcctgcgcatactccccgtagggggtgtctggcagtttttcatagtccctgcgtatcctggcctccgacttctttccgatgccatatttgcagcgtatcttttctacaaaattgaatacggtcttgtcgcacactttggggaaatccggatagcattccttaagccagtcatgcatccgtgcggccgatatatacggatattcctccagagtcccccgcacatactcctcgtatcctgccagtttcagcgtgtatttgcgatgcgcatcccgcctccttacaaaattctcccgggacatccgcagatatctccgcacggtgcttctgtccactcccaggtgcttcccgatctgtgtcttgtttaatccttttgactgaagctctctaaccttgtaccacatatactgtctctctttaaaaaatcggctcgttgttatcataatgatgtctgtctttttgagccggcaaagataggcatccccggaaaagtgcggtatccgcattttccattttcctgctggtaaagttacaaattacatgcatggataagaattccccgcattgggcgggatatacggaacggccgtacttgaaaaaacattcattccggataaaagtgagaacaaggttattttttatcgggtgtgaactgtagcggggacgggtactattcttcagactgccattcccggaactgtcgtaccttttttaccaaagacaatgccgccctccttgagaaatgtacgggggaaaaccgtatgtttggcagggaggtgaacggtatcctgcaatttacttaaaaagtatatatgtataataatagaaaaagtaaatcattgcctgaagttttatacgcaagttacttgtttctataaaaaatccccactttcccttgaaaggaaaatggggacacggtaataataaaggagagccgtccgttatatttcttttgcatatcccgtccgtatgagatcggaaaggaatttctccggagtatcggtggcaatcctcaccccggcctgcaccacataacgttcggcaaaattgtgcatatactgctcgtcggtacagtcggaatccatccagctgcccacacggagttcatgcacaaactcttcggcgttgccggcaacgatacgctcgtcaccaggcaacatatatgtcttcttgttcatatcattcatacggctaatttttttgttcttaatttataatacagcttttgtttctctcctaggaaaggaaaatcttccagtctgattcctgcaggcagagcacccacggatgcaaaggtaatcattctgtcgagaaaacacacccaattttctatttttgtaaaactgatggttcccgaatgctggcggaactccaccgtcctgtggcgtgaataggcttgaaggttcactttcatatacctgctggggaacagcccctgaagttccctgatgtttcgtgccgagcgtatccgctcatcgggaaactggatgagggagccacagtaggtgttgctgccgcccctgcgcgaggcaggcatgaacctgtctatttccgcttcggcatgcttgtaggaaagcagcaggttccgccatgtggtgatgttgaagtcctccgcattcatgtgtacatgcaatccgcagcttccattaatcttgacattacaggcgtccagcacccagcagaccctctccagtttctccagtccgtcctctccctccagtatggggcttacgagctcgaatgtgtcattcccgttcagactgctgtccgttaccagtttccagtgcggacggaggtcatggttgtatctttccgaggccacctcgattcccgcttccgtcagctcgcgtacgagccgctggcatgtgcagttataggcttctatctcgacaccgaactttctcctgaaagaataatcaagttcgggtgtggtggcggtggaagtccctgcggatacgatcagcccctcgtccctcattctcttgtagatattccatacaaacccacggtttccacgggttacaaggtcggcaatttcacggtgggtgagtccgagcagcagaagttttcggattttcgaggtctttgtaccgtcctcggctaaaatgtttctaatttgctcattcataagatgttatctcctttattattacatatcaaaggtaatgatttttcttcgaatttccaaattttatcatgctctttatcagcgtgttagctttgttttgcttctgctaaaagttgtatccggcatttccgtaagctgttttttctcctttcatggggatttttccacatgcccgtcatttcctccatgcgtattcccccttttctgcatgtcatttcttttcatgggatgggcctcccctaaaaacgccctgttccggacatgccacgctgcccttccttaccgggggggctaaggggttcatccccttagtgaattcctgataaggaagagcaagaggtgttcccgcacacgtgaacatgaatcgacgcatagcgttgattattagtatattatacatatcttctgtaaacattggtgttacacttcgttaacaaaaatctgccaaaatattgatttatagcgtttcctgtcgttaacttcacgttgattttgctgtaactgttctactattttactaattttcagaatattataatatattacttctgaaaagtaggtatcatacttgaatccggaatgcatttgaattacctttgtttcagaatttaaaaatgtaacggaaatgagtataggtaaggaaatatcaaccaaagtggtcaggatttctccaagtgtgaagaaaagactggaaatctttcagggaggcgacactccgaatgttgtcattgacagaatgctcactttttttgaagtgaccgggtacaatccacgctatgcctcaaggaatccgacggctttggtggaaaagagagttgaggatcttgtcagaatagtaaagtcccaggaacgtgacattttcaagcccattcttgaaaaactggccggcatgggaggcggcatccatgaatccccggactatgcaaggctgatgaatgagatgcatgatctgcaggaaaggaacaggaagctccagcaacagctggcggagtacggggagggctccccggcggatgtggaaaaagaacgggagaagctccgcaggctggcagaactgataaaattccagctcaatccggacaagttcccgaaggtgaaatttagcgatgatgtcaaagttcccgtcagcaccctgcagctgctcatcaagaagatcaacgaggaatatgtactgtaaagtccaccggcctgtaaatactccgggcgtgtcggacaacaagggaaaatgcgtgcagctggtggaatatctcagcaaggagctgaaggaggaacgtccttattatgatatttttttttcacagaaagaggactatgtgacccctctgaccgtcatgcatcatatggacaacaaccacaggacactgaaacggaacgacgacaagttctatatgctcaccatcaatcccagcggtgaggagcagcagcacctcattgaaaaagtgaccggggaaaagaccggtgaattcccggagctctccccggagcagcagaaagaagtcctggctgaaatgaaacggctcacccgtgagtgcatggatgaatatgcccgtaatttttaccgggagaagatcaggtccggtgacgatctggtatggtatgggcgtgtggaaacataacgccactataaaggcgatgatcccgaggtgaaagccggcaaggcaaaagccggtgaaaggaagccgggactgcagctgcatgtgcatattatcgtctcccgcatggacagatcccagaccgtgtccctttccccgctgtccaagagcaggggaaaccggcaggttctcgacggcagggatgtggtggtcggctttgaccgttcccagtggtccgcccggtgcgcctccaggttcaaccggctgtatggctacttcccttactgccggtccaaggatgagggcctgaaggaatattccggggaatggaaggtaaggaacgagttgcggaacgagactgtatcgagaatcaagcgtgagatcctgcacggggagttcagggaggaaaggcggctgtacatgaatgtctaccgtctgtaccggttcgtggtgaatcccaggaaggccatcatccaggaactgaaaaggctggggaccgatcttctgaccggaagggaaagatgagggccggtccgttcactcacacgggaacagctcccgtacctcctcaagaatccttgcgaagttcctgcccagctctcccggctcaaggacccgaacatcgggcaggggctcctcgttcctgtcgtcatacatctccagctttaccttgaagtagctgacgttggcacgcgtggcggaaccgatgaactccccgggttccagatccgcaaaatcctttccctgatagatgtcctctttctgggacgatacggtcacgctcctgttcgtgcttcccccgctttttcccgcgctgcgggatctccgttccttttcctcctttccgaacatcatgggataatatttcaatgactccacgtctttggtccgtccgaaaaactggttcccgaagttggcttccacggatgaacggtcgagcctgccatactggttctccaccttggaaccggactgtgttaaaagaacaaaggcgcaaagatactcacgcaggacggaaggcagcgtctcaaagtttttgatattgactgtcgtcatctcgtccaggaaatagacgaaaggaaccttgttccgcatggtgaactgccgggaagatatggtcatgagcatgccgatgaccggagcatagaccgagttcttggagaagttgttgctgatggcaaaaagtttcggattttccggatcgatcaggttgaaatcgaaatcgtcccctgaaaggacataggcgatctcctcgttctgtgaaacggtggccagattgttacacagcgtggagagataggatgcctgggtcttctcggaaccttccgccttcagataggcgccggccagcatttccgacacgaggttctgctgcaggaacagggagagctgccttgccgaggcggtcatgatgaaggccagtatatgcggcagcgtgcaatgctcggggaactcgtcccagaaccggaacgccacgccgcggaggatgcccagacctccggcgacccattcgttctgctgttccttcttgggaagcagcgcgagcagcacgtcctccatcagctggatcagttccgtgcggtccctcaccaccttgagcgggttgaaccggtacgaccgttcaggcctgtcgaaactgacatagtagaacttgtgcggatacctgtgccttttaatgaggttgtaggcggtacgggtatagtccgtatccttgaagtcatagatgaatccggcgaatcccagccgcatgtattcgctcagaagccattttccgatacttttcgtctttccggaaccggcccctccgtaaaccaggaagttggagtaatggtaatagaattcgagccgggactcccggattcctgacctgaccggcagccggatgggatcagccccgttcccctttgccggggttctggacaggtcccatatccgggaaaggaagaggattatgaacgaggcggccgccggacacagcatgtatccggggaagaacaggtgggccagaaaggtctcgcccgagaggcatgcaagaaatgcgaccaggttgacataccatctccggctcagcatgcagcaggccgttatcagtgacagcactgccagaagcgacagcttgcaatagaaaatgtaatgttccattgtacttttttagtttttacagctatttactttattaatatcatactttataagtaatccggtccaattactgcatttccgcctggaaggagtgtcccttttccccggccggaaacagacacctgaccgtatatccggaagggacccgtaccatgaccagggggctttcacatcccggcagcacggtaggccgtcccctcaacagggagatccatctggccggggatatcctttccggcctcgcgccggctccacggatagtctccagcatcatggtcatgtcatgggggacaccgttcacatacagggtggccccttctccggaaatccggatttcccgccttccccatgaaaggcttatagtgtttttttcaccgcactcgtccatatcttatttttccgtatcctgttttacatttccattcccgactctcttgcactccccggtgacacaccggatatcctcatcccgtatccggccggttcccttacggccatgagcttcctgccgtcgggaaggatgatgccgccgttaaagacggctttccagtcctcctgcccgagagaggcggggctgatccccgcttttctcatccgttccagaagggaggtcgcatccgtttcgaccccttgccgcctgagaaccgcccgcccgtatccgcaggagagttcaaggtctcctcttgccgtctgtattacggccggttccgcaattccggtgagatttttccggctggcggcgagtatgcccctcagttcccttgtgccgatttccaggcagaagcccagctttcggaggagattccggaaggcggtgacaatcctgtcccataaggattggtccgtaccggcctcggccatccgggccagatactcttccgttgcgacacgtatgtccgtcttgtctgcagccgccatccggagaatctcatcccgtactttttctccgcatccgttgaagatgtcatccagaaaagcatccatatgcttgggacctgcaagctttctgaggccgtaatgtgccacaccctcatgcagcagggtacgctcgacgtccgctttcccccgggcatgtggaagatacaggcagatacgttgcgaggggatgtcataccagccccggatgtctttcccgcaggagagcaggtcgcgtatgtcgggagagcctgcctcgtcggcatgacggatcacttccaccggaatatgcagtttcccggccagaaaagacacatgacgtgcgagctcgtccatccggacgtcccttgaaaggaatatctgcccgtcccgggcgatatcctcggtggaaacggcaagcgtgttccgtctttgggcggaagtaaaatccagcctgctttccacattgcgcgcttccacctccccggcagtggaacggtattcctgtatgccgcttttaaaccggccgatgtcattcaccaggtcaaagatgttctcatatccgtacttctcagccacgaggctgaggggatagtcataatgtctcagtattgtcccgtagggcactttccggtcaagtgcggcaaatatgcctttgggggtattgtcgaaaccgccgccctccagaatccttccgtcagtggcccgcacgatgtccaggatcacattctccaccgtgtttttaaactccccgggattgcttccccgcgcaaagccctccatggtctgtattgcgtgctgtatctcatgggccaggacagacctcacatcatcagtccgggagatgtttatcacgattctgttgtccggatggaggtagcccccgcaatagtcggccgacggcaggtccacaaattccagccgggtccgtttcatttcaggataggcctggaacagttcatcgtctttcacatagtcatcaagatagatccgttcacgcagctcgtcctgttccttcagtccggctgccagctccgtcagttcctcaaaccgtttccactccgcttcagagagtgtttcgccctctatctgccggtcaagaagattttcaagctccccatgccaggactgtttttccagcagtcgtgaatagcccagatctccggccggatggtattcgaaatccgccgtctcataacgccacttgctatcagccccgcgttcccagcctgtcgccgcctttattgttccggcatccttgccggacttttccatttcgcgggcgacggcgaggttctccagccgcagggaggccccttcagaccggtcaagtctggaggcccctttctctccgatgaagcggaaacgttcatgtgcggttatcttcaggtcggcctcgctgaaaatgacatagttccgcgcgccgtcagcccggccgccggttgaacactccgccggatagtcaatcccggtaaaacccgctcgcgaaagaaacccgctggcaagccgctgtgaatcggtatcccggtccggattcatgaacatatagtccagaaagccgtagaactctttcccgctgttccatacatgcgacctgccgctccagaactccgccgtggcttccggaaagaagaaacgttccttgcggagttgcaggaatatctttccctgctgctccgcggataccggcctgtcccagtacagatagttcatcccgttgtcttccggaatttccaccgtatagaggtggcgcggcggctcaatgcgtatcctgcccgcatctatgtcggaaagcagctcctgctgctgtcgctcgaatgcctttcttcgtccgctgtatgtgcttgcggtacgcccgtccatatatacggaagaaatgttccgtttcaaactgtccacatcggtggaagaaaggatctggcgtttccatatcctccatacctcatcaaaataatattcgttgtcaagcaccggggataaaagctccccgtcataggtgatatggtttccccgctttataccgatggccgcatatttgcgggcgattcctttcacttccgtcacgtatgtcccccatccgtaggcctgcgccccttcaccggttccggtaaaggcatggtcgaaatgcccgaaggaggccggactgccgtgatagacctgacggaagcggatgtcatcgacaatccttgaagctgcctccggtgcattttcccagtttccaaaccagctcttgaatgtcccggtgcgtacttgagcccactgtttctcattcagggacgtcggactgccgttcggagctttcatgtacatgccgtcctccttgccgcgcgcgacaagttccagttcttcgtccgtgaaatgtttatcggaagtatgtgtcattgcctgccggcttaatatgataccttgttcataaagagttttatcagcaaaaacttgtttacttatttacatttttataatttaaagtaaataagtaaacaagtgatatatatagaatgcaaaagttgcttacatttccgcattggcctgccggcttgcctggtttatggcgcctgccgccttcagtgcatatcccgcgggtgttctggcaagcatcaatgcgcttccttttcctgcggctccggatgtgccggaaacaaggggcggctgtacggccttccccttcatcagggagtgccattcctcggctttcatattttccacggccaccctttccttgcgtagttccttgacaatcttccccacattgcattccttcctttccggaacggctgccgagttgaatttttcataagctttgacaagcttcttctccctgtttttcccggcagccgagacctcgctttcccgttccgcggcgttgtccgagtactgcgcctcgtaagtggcctggaagtattccctgtttatttccctgatctcgctatccagtttctccaccgcctctctgacctgctttgccgaaggtttctttgccacgccctccgccgctttctttccggagtttccggaggtttcggatgtccgggccgctgccgcctccttgccggcggcattttccagtctgaggccgtacatttccatcgccaatcttttgatctcttctgtaggcgaactgataaacggtgccgcatcccggtctgcgttcagaacgacagactgcaccttttccgtagggttttctatatatcggatattcatcggatcgtttctgacagccgccagttgtacagcctcggacggggcggacacgtatctgatgttctctcccttggcctgcaccgccgccagccgcacgctttcctcaggctgcctgatctgccggaagatatccggacttctctggacggccatatgctgcaccttctccgtcggttccgcgatatgacggatgcattccggatttttctgtacggctgccagctgtactttttctgtcggctccctgattgccgagagataccggggatctttcaggacggccgtcagctgtaccttttctgtgggcttctgcagcaggaagatgcattccggtctcttctcgacggctttcagctgtactttttccgtagggtttgggataaagccgacataggaaggcctggtgcctatgaccgtcagctgtaccctctcacttggcgaagtgatgaaatggatgttgtgcgatgcgtttctgacagctgtcaactgtaccttttccgtcggtttctcaataaagcagatgacacttctgtcccttctgaccgcggccatctggacacgggcggaagggttggcgatcatgctgatggcgcggggattgctcaataccgccctcatgtccttgtcgaacagcgcggcaaggtgttccaggattgtaggcatggctttcaatgtttaaaggatttgacttcatcaaaaaactcctttacggcttccgtatccggttctccgagtttcttgttccccttcatccggaataccagcctccgggctgcggccagaataccggttgtgggcggcaggtccgccttgaacatcctttccacggccgtgaagcaggccaggggggatggggcctgcatgagaaggacactttcaggataggcaattacggcggaaagctgtactttttccgtagtgttggtgaatagccggacaagttccggctttttctgtacggcggcaatctgtactttttctgtcggttctttgatcctttggattgcttccggattgtccagaactgctgcaagttgtgcatgttccggcaacaggttgttttcatttggcatggtagtttcttttttatgttatatttcggatgcaatgataggagaatacactgcaattgtattgcgcttaataaaaattaagaaggtgcatcgtgtattacgacacaccttccattttttattggatttccattctaattacaaaagaccgatactgtcattgtattaatacccggggttttgctcaagattcgggttattatcaatagctccctgaggaattggattgtatcgattatgcactttgaatacacggtcttcaatcttcttgtcagtaacaggggcgttcgtgtcaatctccgcacgtttcgtcggatcagtctcggcataatttacagttccgacaaccctttccaaaacaccattcaggactgtttctgcaaccatctttccattatcatctttccagcgcagaatatcagcccgacgcacaccttccccggccaattccaccccacgttcacggcggatcagccggcgtaatgtttcctttgaagcatacttctcacgatccactttcggcattcctacacgtccacgaatcagatccagtttgtcataaacatctgcagacggaccagaaagttcattgactgcttccgcataagtaagcaacacttctgcatagcggattacaatagggcaggcattcgtgttccaaataccattagcatattgttcatccaaatattttctccaggttaaggcggtctttgaagcattgttcgcagaaggaggatagtttgcattatccttaccattgattgtcttgtccagtgtattgactacagtgccattccagtccattcctgggtatataatggtcatggccatacgtggatcgcgaccggcaaacggatggtttgggtcataagagccggattcctctttggtcaagccgtcagccatttcataagtatccaccaggttctgagtcggaacaatggaggaccagccaccgtcaccattattatacatctggcctattgtgcccaattctaaagtggaattcacatattgaacagccaaaataatctcttttgagtcctgaccggcaactttgaacaaattactgtagtccggttccagatcgtactgtttcaaattcatgatggcctcggccatttcttttgctttcacataatcaccataatacaatgcgctgcgcattcggattgccatagcagcgccctttgcgatccgtcccctttcagagggagatgcattcagttcaccgatggctgtgtccaattctgtattgacgtaatttttcacttcctcctccgacttgcggggaactttagcttcatctgctgagttatagttgtcaatcacaggcactcctccataccaccagttcataacaaaatagcgataagcgcgaatagtacggacctgaccgatcaaatcgtttttggtctgctcattggaaaatgggatctcctttaccttttccaggaatgtgttacaacggcggatgactgagaaatcataaaagcttgcaacagcccctgacggagtcattgtaccgttgccaatggtcttatagttttcccattcaaagttgttatatccaaaatccgacccgcagtcgagatataagatattgccaccatcttcccagctggaagtatcgtagttattaccgccataacacccgatagcaaatttttgggcatcatcctcggttttccacgtagtggcaggagacagggcatccaatggagctgtatctagaaaatcagagcaagatgtaatcattgtcaccgctcctatgatcatatattgtttcaagtatttcataattccatttttttagtctataacaatttagaatgtaacattaacgccgaatgcatgagtacgtaatagaggataggaagacagccgttggcttgtggattcagggtctatattgatcttcatcttatcaaaagtcaatagattctctacagaatagtaaatacggatattctcaacaccaaccgaattcaaccagcctttcggtaaagtatatcccaactgcaaatttttcagacgcaaataacttgtatcttgtaaccaaaaatccgattgtaccgaacggctgctactggccgagtttgtatcgtaaaaaatacgtggcatggaggcatcatggttatcgggtgtccaggcatctctccaaatagtagccggatgagcagcgtcacccgagaaattaccatacacctcgtatccgtcaaacaggcgtttcacacctgcagcaccattgaacatcaatgataagtcaattcctttccagcccgcatttatattgaatccgtaaataattttaggatcggaacttccacaatattcacggtcatcagctgtcagtttaccatctttatttgtatccacataacgcaaatcgcctgccttgaaagttttaccgaaaggattaccgtatttggccgtatatgcatcagcttcttcttgagaattaaaaaatccatccgccctataaatataataggagttcattgcttcacctaccttattacgctggctgtaaccattagtagcatccaggtacttgttagggtcgccgcctcccagatccagaatttcattcttattgtaagagaaattacccgcaattccgaaatcaacctgacctatttttgtattgtagcttaaatttatttctataccactgtttctcatagagcctacattatccttataggcatccaaagcaaattctttagggactgtcacatccataattataccagtagtcttccgattataataatccagagaaccattcagtttattgaataaagtaaagtcaacgccgactccccaagtagaggctttttcccatgaaatggtttccagacgatatttccgttgataataaccagaattcaaagagcctccaaatgcatatttggaatcgagattatacgtgttcaaggcaggataatagtcattgttactgccactcaatgcatcctgattacccagctgcccccaagaagctcgaattttcagtccggacaaccagctgtcttttgcactttccataaatgcttcctcgctgatgcgccatgcacccgagaaagaaggaaaatatccccaacggtgaccttccgcaaaacgggaagaggcgtccgcacgaatgttggcttccaagagatatttacctgcaaaatcatagttaatacgggcaaaccatgaaatcattgccaattcagctgtatacccttcattgctttgggtagaagcatcaccggcattcatatccgtcaattcattattagggaatttcttgcggacggctttctgatatttataattatatttttccgtatgccatcccaacagacccttaatattatgcttgccgaaatttttattgtagttcaataaggcgtcatagtttgtgcggtcccatttataaaaacgctcgtccaactgactgggatcagattctttattctcattatactttatatatttttggaaataattgtaattttgtaaattgttgacgtaagcaccttgcaaggttaattttaaaccatcaaatatttcatagtctacagcggccatccccgaaaaattataattgtcacggttcaccttcatgcccgaatctaaccaggcaatgggactgccgtctgaaattgtgccccaagtgccgtcatcatagcgggctacaatccaaggagcgatcaaattcaactgcctgatgatctgatccgagctgcccccgtagtaggcggaactggcgtcactgtaatcatttttaatgaaagacaggttcatgcgcgcactcaaacgtttattaatcttcatgtccagattggtacgcgcattaaactgttcacgccctgcgttaggcaaaatacctgtttggttcaaatatcccagcgaggccatatattttacattttcagaaccaccgttgatattgacattatggcgatgttgaacacccgtcttatatgccaggtcataccagtcggtatccggatagagcgggtcattcccgtctttaaacttttgcagctcggtatcattgaaacgcttcgacataccttcagcctccaatgcctgattcagcagggatgcgtattcgtatgaccccatacgctcaatcatattcgttgcattctggaaacttagataaccactgtaggaaattttagtctgtccggtcttgccgcgtttggtagttatcaaaacaacaccgttggcagctttagaaccataaattgctgccgaagcagcatccttcaatacagaaatgctttctatgtcattagggtcgaccgcactcaatgtaccggtttcaatgccatccactaaaatataaggtcccgcttcattcaatgtgccgatcccacgaacacggattttgccggcatcctgccccggtgccccgttggttcctgtaatagcaacacccggcatcaaaccttgcaaaccactggatacattctgaataggacgattctccaactctttgctgtctaccatagcaacagaacctgaaagattcgcctttttctgtgtgccataacctactaccacaacctcacttagagtctttgaatcttctttcaagataacattcagcgggctgccgttccatttaatctcttgtgtctgatatcccacataagagattacaatcacatctcctttcttaatcccatcgaggctaaaattaccatcaaaatcggtaattgttccgttagtggtaccttttactacaacagaggctccaataacagactctccggtagcatctttcacaagtcctttgcatattcccgcttgctgtgtggtcgcaaaagaatttgctccagaggccgtagctgtagaaattgttccggagaataaagttccaaggaataataccatactaacagattgcagtctttttaacataatattgagttttgaggtttattaaaactatagatatttaaaattttaataactataatttcaatttgatttaaattaacgtcgcaaatatataataatttttaaagagacgcaataacagatgaaaaagtttgagttgaaatggaaattatacaattatataagtatccggaaagttggtccccattatggattataacaaatttgataacatgtcttattgaagtttgtactaatattcttgaccacctgtcagggtcattgcttcaggattaaactggacggggactgtttggggactcttccggtattgtagctcgccatccaaaaacattgcatggatgttgagcgagtcagggggggcgagaacgatgcaggaactgtcactccattgacaatttctgggcagtacttgtttatatacatttcttctggaagcccattggagtgaatattggaccattcaaagttgatgtcaacagcatacaaagatgaagaagcacataattcatgtgagatcttttagattaaaaacatcaaactaaaaaaccgctcctacttgtcacaagccggaacggttcagattagttacgttttgacaatctactttatttctcaagaacaaaacaatggtggatttgttcacaacagcttatccgaaaagaaatgcacagtaggaaaacacaaaaactccccagcttatcacaagccagggagtcataagggaaaatccccatacgcccttattcctaatggtaacaacatgatgaaaccctatcatacactgtcaggacgacatgggatgcacttttctcctgtttcttcacatatgaaaaaagacagaaaatatgtattcagtcccgtttctgtattctgcagtcctttacgttgcaatagtgcaggaaggggtcagcccttgaacctgtacatgtgcctcacggcatgttcatatgacatctttgaataacatcaatcggaccttcacaggcctgaaagggaaaatgaaatactgcggtcacttcaacagaaacatacagacacatcaaaagtgcagtttaacaaaaaaaacaaaataaaggatcgaattgttttgaaacacgggctgttttatatattttaacaaaaaataatggaatatattcttcctgcaatacgggagcttccttcacggcagaaggaagcggcaacatatccatataatccgaaggttcgcaaccgcctggaaaggagtagtgaaaggtctgacaaagccgggcccataagttcactcaggaagataaggcagcgtgtgccccgacaataagaatgtctgtaaaaaatggaataccgtgcactgtattccaccataccaaaaagaaccggtgaaacagccggaaggaacgcctagcattatgtttctaacagcaagggcggaaaacattgtagaaatcctattaccgccttgaacgtatacggacgacagcccgaaaacgacacctgcaaagaacaggcagatgaatacaaacagacaggtaagttttctccaaagtatcctccccggctgactctgataaaccctcccggcaaaccgggaggggatccacatacacactccatgcataagcccttcccgcatttgctgcataggttgaccgcatccctgtccggataatagcaacatttcatccgcacgtttttatatacatataaatatataataaaatcacagaaattgcacaggtttataaaattattaccgaagaatgagcattccgtatggcaggtataatattatatgaaaaaatgcctctccggaccgtcacggaccagaaaaggcatattctcattataggaataggatacggctatatacgcatgatatttgagactgataacattaggtataaattgtttccgtaccgtatcctctattggataacgagttcatgcccgtattgttcatcatatgttttttcagtcacataacggccagataccatatccaaattataatttatacaccagtctttgatacaagaaagggaaactgtctgaaacatatagtccagacaatccctttccatatcacggtacaggtaagctctcttgcaataccggcacatgtgcctcgcggcatgctgatctaacatctataaataaaacttccgaacttccggcttatcacaagcgggaaagacaaaaataatttggtggaagcgagttaacacagcttgttatttttatataaacatattttctgatagaaagttcaatctaaatttggctttaatatttttttaataaataaaaagaacggatattaacgaataaactatatggttcgtttttttctttatttaaattctgtcaataaataccgataaaaaaggtaacatgtactttggccgcaaatattatgatcaggccgctttggtttcaattatgatatttaatgaagggacgcttgcaatgaatgcatctgccaaatgaaagaaggtgtgcattttgcacaccttcaaatggaatttaaggtggtgtggccgtttcaggccgcttcagtcatttccttgtacagcatgatgtccgtataggacgaactgtagttcattctggccgtaagggtggacatgccggcccccttgaaaggattgccggtttccggatgttcctccatccaccggcagaaatccagtatgggggacttgccggaagtgaaatagacgaaagggtgtcctttcagtaccagcaggacatccagatagtccgtaagtttccagtccatcctgtatgtgctgatatccgtcgctatgtaggggggatctatcagaaagaccacatccggggagtccctgtacttgtccgtcagctccctgtagtcacagcataccacctcgagtccgtcaagatagccctcgcaactgtagtcgctcaagcgtatattgttgtagaagttcagttttccgagctccccgatgttcctggcatatttgccggagaacagcagggaggacgagatggtgagatagtccacgaagccggtactttcctcccagcggatacgttccaggaatatgccgtgcatctccctggaaagcatcctgtggcggggaattccttccgagaggcggcggaggtcggaaagcagggtgttcgtccggctgatgttctccagacgctcgcggtagttgtcgtggtcattgtagattacggttgcgtcgggtctttcccgcttggtgatgtgcgagagcagtccggaaccgccgaacaggtcgacgaacaccgtcctgtcgctgaaacgcttcaagacttttctgaactccgatgcgaacatgcgtttctgtcccacaaaaggaagcggggcctggctgtaatagcactttttcattgctgtaatcattctgtcgtgtaattgagtgtttaagtttcggatgcaaagttcatctcttctccccatgaaagcaaaaattccattcttttcatactgcatggaacgtacattcctttttgaaccgcccgagaatctcatacacctttctttcggaaacgccatgcctggccgagaggaaggccacacaatacgtcaccttttcacctttgcggcgcatttgctcgtactccttgtacaggtcgatatatttatagtcgtccggcttgtaacctgtcccggccagacgctccagaagctccctattaaaatttagaatctcaaacagtgtcatagcaaatatttttctatctttgcagagccaatcattcaacgacatataaaaagcgcaccccgcgacgaagggtatttgcccccagtcgtgcggtggtgcgcatttatatgttaatgagtgattggcgttactttttaacaggctgggggcttttttactttcctttccgtacaaaatccccgcagttctcttttattatgtggcgtatgtggcaggctctgggcctttaaggctgcaagatataccacaaggctgcaatttcgttgcagcatgacttttattttcagaaaaacacgtttgctctcgggaatgatttacttgtttatatattaaagtaaataagtaatatacataattatacatatttatatatcaagtattacaacgtgaaatatatataaagtataatacttataaagtaaatatatagagaaatatttggtaaatatttcaaaaatgcgtatctttacagcgtaataatcaaggagatagataaatcatgaaaacaattacgacagcatgtgtaaaccacaagggcggtgtggcaaagaccacttcgctgctgaatctggcggccggtatcgcacggctgcacggaaagaaggtatgtatcatagatgcggacccgcaggcgaacacgacgatggcggcattcggggaggaaatggcaagtcttccccaggatgtcatgctagagagtgtggtgcaggaaatcatgcaggacagtcctctggagctgaagcctctcaagtggctggacagggtggatgtgctaccggcgtccttggacctggcggccacggaagtgatcatgaataccacccccggaagggaatttcttttcagggaaataataaaaggtctggaaaagaagtatgaccatattctgatagactgtcctccctcattgggcatcatcacacagaacgcgcttatggcgagtgattttgtgatcatacccacggatgggaactatttcgccatgaaaggaatcgagaagatacattatatcatcggcctgctcagaaggaagctcggcgcggaggtcaggattctcggctactttatgacaaaatataatgcgggaagaaagctggacgtggacatcagggagagcctgatagggacattgggggagagcgtgttcgagacaaccatacggaacaacgtggctttgggagaggcgcagtacaacgcacggagcattttcgattatgcaccctcgtcaaacggggcaagggattaccggagtctgaccgaggaattccttaaaagaatcaggaaaatgaacaaataataaaggagaaggaatatgaaagaattcaaatcgaaagggatttccctagaaaatatggtgggggcagaccccatgaaagaaaaaaaaacggcggggacaccgggaaaggcgtataaccagaccattgtcctgaccgaggatctggtatgggaactgaggacatttgccgcggaccaccgttacagaggggtaaagactgtgatagaagcgatgataggctgctttcttaaggaggacgggacattggaccgcgacaggttggaacagttctgggaagaatacgtaaagaagtaaagttttatattacttattaagtgacaattactttaagtaaaatacttataaattgtagatactaattgaaaagtgcgctgtattctaattgaaaagagctccatccatattccaaaacggacaatgacgctactttcatgagaataaaggaggatgccatgcgtaacggccagacaaagcccggttacaacctccagatcggcaccgggaaccagttcattaccgactttgcactcttcccgaaccctacggatacactgaccctgatacctttcctgcaatccttctcaagcagatatgacaggctggcccatacggtggttgccgattccggctacggttctgaggagaattaccgcttcatgtcagaaaacggtatggaagcctacgtcaagtacaactacttccacatggaacagcggccgagattcaaaccggacccgttcaaggcggaaaacttctactacaatgaagaacaagacttttgtatctgccccatgggacagaagatgcaaaggatagggactagacatgtgaaaacagcatccggatatgtcagcgaaaatgccaggtacagagccatcagatgtgaaggctgtccgctaagatgccgatgttttaaagcaaaggggaacagaacgatagagttgaatcacagactcagaaaatacaagcaaaaagccaaagagttgctctgctcagaggaagggctgaaacacagaggacagagatgcatagaaccggaagccgtgttcggacaaatgaaaaacaatatgaattacaaacgtttccgccattttggaaaggataaggtcttcatggactttgccttctttgccattgccttcaatataaaaaagatgtgtgcaaaaatgactaaagaaggtatggattggctgattagaccgttttatgagcttacagttgttctatttagatgttgcgaacgcataaatcaaagaaatcctcaaaatatcgcagcttaaaaaaatgagtcgatttttatagtcaatgaaaaaaagaaggcgcatcgtgtattacgacacaccttcttactgtctttttttcttcaaggtggtgctaccagcaaccgaaaacgggttgttatgacactatctttcagtaagttgtatctttgctacgatgtaagtcccttgaataaggttttcacagctttgcaccgttcaacacaagtttgtatcttgggtacgatttctgaatgcaaagataagtattattatatgaaagcaatattttgctcttcataatttgaatacggttatcgttttttcttccaataaggtttagtccaaaaagagtaccctgaattgcgatagcttcgttctggaacagcagcctgtaatattcgatccatatcataagaattgagataattgtcctttttagctatgaaaggatcaagccaatcagctttctctctagcccattgtatctttgctagcagttcatcatcagttttaccatcttcaattgcatggttctcaaatgcattaatatattctcttaaaatattagtttttcgaaaacgttcagcagagtataataggtctttaaagtcttctagctcttttcttttctcttcttcgaattcttctctttttcgttcttcttctttacgtcgcttttctctctcttctgcttcaatacgttctgtctttctattatctgcttcaatctctaggtatgctactatactaattattttatcttcgattttagtataagccgtatcatgaactagtgttgggctatgaaagctcgaactatgataaatataaaactgtaattcgccagaaaagatattattattgttatcacagcgattactgctattaggattttgcttttttctttcagttaatcttatttgaatttcctcaccatcaacaatggcataggtctgattgtctttgcatttaatactatgtcctctaaaaattaagccttttataattgtatcaaaaatagatagtgctctatctagcatattctcagaaacatagaggtctaacgtttctcttattttacttttatagggatttttctttaaatattgattttctgatcgctgtctgaatttttcttttgtgtcgattattagaggatttttagcatataagacttctggaaccttaaagcatgaaatatcaccactgcaaatttccagttcacgttgcttgtatggatttacggatttctccatttctactttaggttctttggcttcttgaagtgttgttgattgagttgcgtttgtttcctcttgttggaacggtagaggtgtgacttgcttaccatatttcagttttgcccaataccccaaaggtggtgtgggtatattcatcgatttacagcgttttcttaaaccattatctgaaagaccaaaacgtttacatatggttgtcattggctcagaccatactaagtcatataattctttgcgtgtcagttccatactgattgagtattagtagtttctctttgatgtatatttttcttgtagagtagcaacacgtcccttctcaacccatttaattaattcgtcctcaaagaaataaactttgtttccttgtatataatgaggtatggttcggcttctgaccattttattgatgccatttttagtttgatttagaatttgacatgctttttcaatatttataggtctgtgcttatcaacccctaaacctaattgtgactctatatgttcaagtaaaactctcatttcagcaatttcatttataagataatttactgctttaggagtgttttgcaaagtcaactcctctttattgattgtttcatcagtattcatatgccaaacagttatattgattaataatgctatgataatgtagcttactgttgatttataatataatacccccccgttttttgtgcccccctaaactcaattaaacctgatttaactaaagaatttaagtggcgttttgctgttggaatacttttctttattaattctgcaatcttggacgaattgagtccaggatatttctggattatctttaaaacttctttctccttgctatttacagtatcatttacagtatcatttacagtatcattcttgatactgatacctcttttgaatataaccgtaaacatcccgtccgtatgaaaatcaggctcaggaagattggcttctttcatagcttcttgcatacggggaatgccggatgccaccctttcaaccaaatgcatacgggtaaacaatccaaagattaatgggttgcgtgtcatgctcttgtgtccgaaatctttagctacgataggcaaaagccctccgggattagaaacctctacccggtcatcaaacatttctattgtaatggttgctccctgttcgtaataatcacgatgtgagagagcgttaataatggcttctttaaacacagtaagaggaatttcccaaatttcttctcttggtcctgctccctcaattttataagctacttgcagtttactttctagccatgccatagcctgcaaatattgttggtatagtggaccgccaaaggttttatcatcaatgatatatactttggttgttcctttgaaaaggacacatcttgttactgcgtgtggaaactttcgttcaggttgtttcccaaagaacatggctgttccattcttggctactccgttatccgtaaacagttccaaattctcaaatatctgtttgttggcagtcgatggacttagctttgcttccgtgcgaaagtcttttatcgcttgttcatctgcatctgtgtaaatgttgaaccacgaacaagggatagcatcaaaaaatattttgttgcattcctgaaagaaactgcgcatttcttcgacagtacgaagtttctgtgagtttgctccctcacgcacaaagatagaaccggaaaatatataaggtttatctttccctgatggaacatcaattacccaaactgtcttatcctcgatatttaccgcatacatatcacaatggagagctggagatatttcactgatagagccttgaatggctgaacgtttgtcattttccaaacctgtaccaataatctgtccgttatcatctacgccgataagcaaatatcctccgtcagcattagcgaaagcgcaaatttcctctgttagttcacgaacttttgaaggtacacgaactttaaactctacattatagccttctccgctatcgataagtgattgtatggtttctgtatttgtcatagacatctataaatataatgcaaaaatagtcatttctattgttttaataactctaaaaacaaggatatatatatggtttacttcaaattgttctttctgaaattagaggggctgcatcctctatactttttgaaaaacttattaagatggctctcatcggtaaatcccaattcttcaacgatttcacaaattctcatttgactatgtaataatctattttctactaactttagtttgtagtttaaaatgtattgctgcatagtttcattagtatgttttttgatatatcgtcctaaataattctccgaaatgccaaaatgttggcttatatcttttgctctgattttacctgttttatagatgtttgcttgaatatactgcaatatgtcaagcgatttgtcctcagagcattcatccacctgttcaggcaagaacattgcgatattgcgtgctaccacaataataatcgtattaattatttgtgttataatctccttgctgtataaatttcggttaatatattccctgataatcgcttcaatcatgggtttcaccaatagcttatctactttatttcttagtatacaaccgggttgatgattagcatgttgaagaataaactccagtctttggatattttcagcaccgaaaacagaagaatgtatatatatgtcgttaaacttgatgtcgacaaacttagttgttgtatggatttcgaaagaatgcgtatctccgggagtaatcataaacaaatgtccgtcatgataaggaaacatattgttgttaatccattggatgcctgttcctgaaagaatatatactaattcaaaaaaggtatgttcatgctcttttagcaaggattcggcaagctcgctaaaactaatttcgaatggttgatgtaggttttctcttttcatgccataaatatagccctaaaaaacggattaataccaaaataacgaaaaataatacctaaaattagccgaaaaatcggtataactttgcaatatatttaaaattatagcttatgaaaactgaaatggaaaaatgtttggcaggtgaatggtatgattgccacgacccgttttttatggatttgaaaagtaaagctcatcacttgttgatgaaatataattctttgccgtatgaacaaaagactgaaaaatatgccgtactaaaggaaatgtttggaagtataggcgcaaatgtttctgtcggtcattcgtttatatgtgattatggatgcaatatacatatcggtgataatgtcaccgtaaatactggttgtacatttgtcgattgcaataagattaccatagggaacaatgtgctggtagcacctaatgtacaaatctatacggcaactcacccggtagagtttaatgaacgacttgtattgacagaaaccccggatggctgtaagtatgtccgtcgaacttttgccctccctgtcatgatagaggatggctgctggattggcggtggagtaattattttaccgggagtgacaatagggcaaaaatgtgtgattggtgcaggaagtgttgtaaccaaagatattccggcaaatagcttggcggtaggaaatccttgccgggtgatacggaaaatcaatcaaatgtaaggttatgattaaattagtagcctttgacttagacggtacaatcggagatacaattcccatgtgcctcaaagccttaaaaaaggcagtaactccctatgttacatatataaatgatactatacctgaactttgcatgtctttgctaaaagattttcgaaatcaaggtttgggtagtttattaattaagagaatgcttgatgatataaagtcattaggttataggcatatatcgttgagtgtttcaaaagataattatgcagctggctggtatagaaagttaggcttcaaagtttataaagaacaaaaagaagattatataatgatagttgatttatagagacttaatcctataatataggggagtagataatctattaccctatattttaatctttgttttcccgaactttgcttcatcaatcgattgacagaccataatgtataatcagaaaaatgaagcaatcatgtatatagagaatgacgatttcagcgtatggatgcagaagctgtacgctaaactggaagaactctgcaaggatgtacgggtactgcgcaatgccgacagggtgctgcccgaagatgacaacctgctggataatcaggacttgtgcctgctgttcaaagtaagcatcaagaccctgcaacgctaccgggctatcggtgcgctgccgtacttcacaatcagcggaaaagtgtactacaaggcttccgatgtccgggagttcatcaaggagcggttcagcgtcaccacgctgcgccagttcgagaaagaacactgcacgaagaaaaagaagtgaattaaaaagccggggcggttctgccccggcttcgctttgggtttatggtttgcccagcttgtcggcttgatctcttagctgctcggcttgttcgttcaacagccttgcccgttccaacgcttccgcctgcttcctgctgcggtattcaaagcctttcaccgaatcggtcaggcttcggatgaaagcgttgtcccgttcccggctgaacttcgtttccagcaaatcaaggctgctgccgtctgcctttcctttcatcaggatatagcggtattttatatcgttgtcctgtaaccgctgcattctttgtataaaccgcacattcaatgcaagcgacacaagacaaatgattatccctgctgaaagaagaaagaacttgggtttcaaatagggagttacccggtatgtcagtttgccgtaccatgaaacgggcgttatttctccggctggtgtatcatcagccgggaacaacacctttaaccgctccttgaaatatcggtgcgaggtcacgataagcccctttatatcttcaaggtcttgtttttggttctcggactgcccttttccgatactgccgatttggtttagaatctcccgcaccgtgttttcatgaatgccggatttgccctgcatatccgaaatgcgctgttcgataacgtccagtcggttaatcgtttcctcccggctggctggcgttacctgcctttcctgccgttctttcagttccgtaaccatggagagaagcccctccaaaattaagttattttccatgttcctataattttaagtgtcgtttctttttcttcttttttctttcaccgggattgtcgggcgtatcatcagccagagaggatgaagcggagaacagaccgcccaagcctgccagtaacggactgtcggctttgcccggtgtctgtgctggttcctgaacaggtgcggaaactatctgcctattgtttccggcagtgttcagccccacatccccgaaacatttatccagcttggagaaactgaaactacggtctatctccgaacctttgaacgtgtattcacctttggaaaaggatatgccctgtatctcgcttgtctgccccttgtatttgaactggatagtaatacccttttccgctaaccgcccctgtaactgctgccagttcttggacttcccggattcattttttacagcgttgtaaatctcgtatttggatttgtccggttctctcaaacggtgctgctttacatgctccttgcctttagcgaaataaagcccgtgtttggctttcagcttcttgcatacctgctcgttgcggtacatgtcgttcctgtccgaaatggtcttgccgttgttgtctatacggttgaacacgatatgcacgtgcgggtgttcccggtcttggtggcgcacgatgatatactgcgtatcggtgattttcatttcacgcatgtactcctgcgcaagctgtatcattttcccgtctgtcagcttgggtgcgtccaccggggaatagcttagcgcaatatgtccgacaggctttttcaggtcggggttcattccggcttgcagtatgaaactgcgtatgatgtcccggctgctttccgtcaatactccctccgcatgaagcaaagcagcctgttccttgccgagtacatagttcacgcagcctttaaatccgcttcccttttttatttttccaatcatccgacaactggttaatgatttcaacaatcctgtttttgagttttaccagttccaccgccaccagtgcgaaccctccggcattcgcccggtgcgccaactgattgatgttgttggcttcccctgccagcttgcggatagtgtccgcatcctgcctgttcagccggggcgttacctctgccgaaacaaccgcctgccggacgtactcgctgacgcacagcccggtttcggcggctcgctttctgattgcgtagaactgtaactcggtcagcttcgtgctgactacccggttctgcttgtctatccggctttttgccgggcgacctcccgttttgttctttatctctgtcatagttttttgcttttagctggtatcttaaaaattgcgaccaacgggagaaattttctttgctgtcaggcaaagcaaggtgtttcggtttaccgaaacataaccttgctctccctaatcacacagcctgccgtcggttcatgccgccagccttgcaggtcacatccttagccctctctttcttttttcacccggattttgtctgttatcatgctccggctggggcttgtcggtaactgtcaaatcttgggattgcttcactttaaggctacgcagatagtcgttcaggtcattgtgaccgctgtacaggtgtgatgcgtcacgtacacgccatttgtattcctgccttatggcttcaaccgctttcctcccggcttcgtcattgtcaagcatacaatgtatatgcccgtaaccagccagcggatataaggctttatccgtgttggcggtggagttcaggataacgtagtcctgccagtcggtgcagggtatatccgggcttttctgttgccggatagtgaggaatgagaggaaatccaaaaagccctcgaacacgaaacaggtatctctcggctctccctgctgccgtatatgggtgatgtctttcgatgtgctgcccttgaaacggggattgcgaagctcgtaacctcctgaatcattcctgaacgccagcgcaaaataaggcttgccaccgatgcggtaatacatttcctgcacgtatggggatgccgttccgggggaaatctccctttcctgcaaatagcgtatgagtgccggattctgtaacggctgtattctgcgtatctctatcgggctggctgcctgccttttcgtgtccctttcgggcagttctttcccgtgaaaggaaaaagaggcggtgtcgccctgttccagtcggcagatagcaccgtaggcgttgcactggtgttgcttcattacaaggtcgatgagcgtcccgccctcaccagttccgtagtcacaccataaattggcgttataatccaccttgaaacttggcgtgttgtcctcccgtaaggggctgcggtacatcccgtagcttcccttttccttggctggctggattcccaaagagttcaggtaatctttgatactgatattgttggcttccttgtaggtcataatctttatttttttatttaacgatagtaataatgaagcaagaagcgagtaagaagaagtacgggacactactacatctatctttttctttttcaacggattgtagtacatgtagtaacatagtaattatttatcctttaaaaaaggaataaatatattctatatattatattgccgttttttctttttcccggattttccaaaagtttgggattctatcttacttcatactacataattggtaaactgttgtttattaaatcattatgtgtatatcagacaatatgtagaagctactacattccggttctacccgtaatcatcccctgtacgggaagccggaacgggctttatcctgtacccatataccggataatggttattgttgatgcgcttctgtacccgcttgaaaccgattttccgcaatgattcgcccagccttttttcggatagctggacgggggatatattacgcaggtatgcgagtacctgtgccgttgtcatgaagaacagggcttcttcctcctctgtcggcttctcaaagtattgtgtcagcatctcaaactcgattgtctgtacctcaaattccgcatttgtcaggtgcagttcttcaatctccgcatcattgaaccagtagcgcacgccctgacggtacaagtacatgatttcggaatagacgttatccatgcggatgctttctgccgtgggcttgtctatgtgcagcacctcgaacggcaaaaaacgcctgctgcctgtcgggtcggtcaggaactcgttgccgttcaccgaagccatgaagctggcgaggtgcgggtattcctcgatgtaaatatcatacggtctgcggtacttcaccgccggagtggtgataagattcttcaatgcgttctcgttctgcttgttgagttcctttagctggtcgtcaatgttgatgaataggtattcggctatcagtgtcaggatatctttgccctgcgggtctatcttcccggtgaacaggtagttcttaagcggtgtcgggcaaaggttgtccagccaccacgatttgaattgtccctgcctgtccccggtcagtaccaaacaggtatggttctgacatcccgtgtcgttcatcgcgttggctaccacaccgataagccatttcgtgaaatattcctcccatttgccggggttggctacctgtaccgtgttcagaagcctgccgatatgcccgtgttcggcaggattaagtaagggcagggcgttgaaatactcctgtatggggtgagcctttcttgcgaagtcgctttccagtatcatgcgtatgttgtcggttgaggtggctatgtcagccgttgcgtccagcctgcgcctgaaagtgttcagggcgaattttgtaacgggctggtacaagtccgaagaacccgcagcccggtattccgtccggctctttacggtgttgaaccggaaatcgtacaggacgttcaacaggctttcgatgcgctcgttcttcgactgccagccctcgatatgccgtgtttcatcacctcttttctttttcatcgggaagtctgttagaagccgggacatactgctgctgcatccactttttgagttcctccatgtcgaaacgcagggtacgcccacgcttgacgcagggtatcagtcccttgctggctaaatgatacaggtaattgaccgaatacccggttatgccgctggcaacggatattttgactaacacaggctcttttccgtcctgccgttcttcgggctgtgcgcccatgaccggggcaatcatcttttcgatgttctccagccgtttgaaaatttcttcgaaaggattattcataggtgcttgttttttgaattagcaccacaaataaaataagaaaaatcggtaaaaaacaaagcgtcagccgtttggaatcgctttgctgcgctctgcaccaaattaatgtcggtaaatagaaaacggctttgtgttcattaccttacttaataagtaagtgggggaaaccgggatttctgttctcttattgtttctttcctgctcgtttggggcagtggtggacatttttggacacgcaaggtcatttgcggacagaaagaaacaacctgtcattcagtcttatatatttgcaccagtgaagaaaaacggagtattgataataataaatatatcggttatggaaatagtgacgattgaaaagaaaacttttgaattttggaaacagaggtttgaagattttgtggggcgtgtggatgcgctctgtgtgcctttacgcaggaagcgtgacaaatggctggataactgcgagacctgccgtttgctgaatgtttcagcccggacgatgcagacctaccgtgacacggggaaactgccttattcgcagattaacaataagatttactataaggcttcggacgtggaaacatttctgcttagccaagtaagggacaattctaaaaagtaggcgtatggatttgataacgaaagattccgaaaccacgctggtactgttttcctcccttgacagggtgctggaaaacgtggagtacgtggtaatgaactatcgcccggtattgaacggtgaacactacttgacgggcgaggaagtgtgcagacggctttgcatcagcaaacgaacgttgcaggattacagggacacgggactgctgggatatgtgcagcttccgggaaaaatcatctaccgggaaagcgagattttagacctgctggaaaggtattacagaaaatgaaatcttgaaaacgtgaaatcttgttttctgtatttattgtttgattaattaaaagccagcaatcatggtttcttgaaaactatgttgctggcttcttcatgtttatgcggatagtcttttcaatatcttgttaattttgaatttttatgaatgctttcccattttgattctctataattttcattgcaggtgttgatgaaaatgtatgagttgtagcatgaaacacagacagaactaaatcttgtaattgagagtctttttcaagatattctatttttaacccttttgattctgctttttcacgggatatatggcgaccatgacttttaaagttatcgtgattagccaaaaaagatgctatattctctataataggagctttgacatctggagcttctgttttgaacatgaatctattaagccaatctctaattaagttttcagacattttgatataattttcacattgtgtaatgacagaaggaccatattgattaagtaatatagcccatgcttgtttattgggttcgtttacttcttgtaatgctttatagaattggtcaattattgcttttgctggattacttgtgggaccgttaggactattaataatcaactgtgggtctacgggacctatattagaatgttttcccatgacaatactagctcctgaacatgcaatcattgtggcagcagacattgctatttggggaataataactcttacttcaggaaattgagcatgcaaatattcgacaataccttctgctgcttcgggagaacctcccggactgtgtataattaaatctacaggctttttttcaagtccgtatgaaacttccatcattccttgcacatcttcctctgttaccgaaagtaattcgggagctccacctttttgggtaaaagcagttgcgtacaaaataatatttctgtttgtatatttagatagttcagaaaggtatttgcgtcgaataaaatcaaaaggagcagaattcccttgggcactttcgacttttaattctgttaatatttcactccatgttggcataattgattcggtttagatttaatgttatattcaattgaagaatttgcagaaacagtgtcactgacggttttataacgagttccactagttatttcccatttttgtttttcttgctcttgcaatatttgatatatcgcaggattatttacttttaagttttctatgattctgttcatggctgttataacgattactttaaatgcaaatataggcctttttccttttaaaagtttacaattcagcattaaagttgctgaaaaatgatatttttctctctacgtattgcatatcccttagtatcgtttggtctaatacctttgcgtagtgctgcgtcattcgggtggatgaatgccccagcattttagccacgttcggcagtgacacgttgttagccagcgcaataaccgaagcgaaactgtgccgggctgtgtgcgtggtcaggttctttttaataccgcaaaggtcggcaatctctttcaggtagctgttcatcttctgattgcagggaacgggcaacaaagttcctttatccatgcagtaggggttatccttatacttttcaagtatctgtttgggaatgctcaaaagcgggatgttacagaggttgtttgtcttttcacggggtttcactatccacaggttgccgttgctgtcctctgaaacgtgttcggggcgtaagttatacacgtctatgaatgccagcccggtatatacgcagaagataaaaacatcccgtaccagttccagccgttcaatcctgaactctttctgccatatccggtttatctcggcttggcttaggaactgtttgtttacctccacctcgtgaaacttgattcctgcaaacgggttctttgtcagccactcgttggcaatggcaaggtttatcactttcttaaaacatttcatgtaccggataacggtattctgtgcgcaatgcttctccgtctttaggtataaatcgaatttgcgtaccagttccccgtttacctcacgcagtaacatatcatctaccttgtaatcccgtttaaccagttccatgaggtatttaaggcaattgtcgtaacgtcttacggtgatgtcggcatagtctgtcccgattagcttccggcagttgtcattatgttccttgaatacattatacaatgtcttgaaagtttcgtcctttccctgatagcggttcactatggcacgtgcggagataatctttccctccagttccaagtcttggtaaatctgatagaatttcacacgcagggcgtcaatgtaatggttaagttctacggagtttcggtctttgcctgtcgacttctctttttcctgcgaccaaagtgggacttttacactccgctttagttgaagttccacgtataggcggtcataagtgacacgcacacgcacgggtgcttccccgttttttaacagtttgctacgcttgatgaagaacaacacgctgaatctttttctttccatacggctcaatttttaatgatacaaagttaggaaatcgaaccgagaaccctgttatgtaaaatagtgcaacgtgctgtaaaagaatgaagtaaatacctcgcagtggaacatttcgggcttttaaaaacagtcccttgaataaggacgtatggtttgcttcaatcccactaattttgcctattcttggaaaaggaaaatccccgaacttctttgaaattcagggatttacatcgttttgccttcttaaaaagtggtgccaccagaaatcgaaccttttgcttcggcttattctaactccttgagtgactgtacatttattactttatcttttatgaaagccattgaattagcatcacactaaattcatcgtttttcttgactaatcttgtaatctttatctctttgacgttgcaaagataaataaaaggttcgatttctgcaaactaatgcatatttttttgcctgtttttgtcaacgatgctgtttatatctatagtctctgcctacagtgtcattgaaacagtaatttgtatctgatgtaaataaagacgttgtgtttccgtatatgctttattaataatcaagtgcttattagattttttctttatttcctatacttcttgcattatttgtactcctattctattactgatagccgtttctacggcatcgtaaatttcagttttcgttgtctctattgatacgataagtgaatatttgataacattatcaacattagctaatttcctttctttccaccatccttggcctggataaacaattatctgcccacaagaagccaattcagcggccgtacattcgatccagtcagattgtacagtaccttgttctcttcgttgttgtttgatggtccatctgttagtatcattgtcagttctcttttctccttcacttttatttcttctgcaaagaaactcttccatactctcgcttgcacttttcaagtcgaaatgcagcgtagcagatggataacgatacttgttgcttcttcccgcatatccaggagacggctttacataataagatagtgtgattcttatttttacattttcttctcccatttgttccagcacctctgttggccaaggcaaatcataaaagtgcaattgattataggtgtttgaaccatctttttcccaatagggtattaactcattttcaaatataaacgttgcatatttttcattactgaataaggccgtctcttcatcaggaacaccatagccgcataaaggtataatatccttgatattaccgatacgtatcatttccggtgtccatttggcagaatgtaccatcatgccacgaacagacaacatggaaagagttggtgttgctgtttttatttttgccgcaagacgtgtcgctaatgctgtagccgcacttgtagcatggaactgttccaatgattccgccaaatcttggcaggtagtaatcaaacttaaatcaggatgtgtcgttgtttgaaaaacaggatgataggctatattacctccttccatgactatttcaggcttattgcaaccatttctccaactccacgaacttcttgacatgggtgacagattccctggagctgccagtgccttgtagctttcatctgttactatcgttttctccgtatatgctccgactgttaatgcgttccatgcttgagccggactttgtacagcattggctttgcaggactccagataatttgtggcatctacttcagggggctcaatgttgcccgctgaaacgagcactaagcggtcacacttgccattatggtatatgctttcatccaatgacgcagaacttgacgttgactttccgtcatacgatgtaccatcagttacagccatacattgtatagacgcccccatagcctgagcctgatagatagcatcttcaattaccgctccatagaaatccggatctgttgtatgaccgttctctacaatcttcacggaagccaagtcctgttctatgattatcggacctccatgtcgataagttatatccgtcaaatctccataaagcataagtccggccatacctgtaccatggtcactgtggtctgttgtatccggcacgctgatagcacttttcattctgtcattaggaagagcaggtgccagcagtttatgggcattgttgacgcctgagtccaacaagcctattcttgtactgtctttatcaagcgcaaattggatttctccttcaatcagttcactccactcgcgactttcgctccgattttttataagtatcgatggctgatgatagggacgcactccttctatataaccgatagatagcggtaattcacataactgttgtttggttgcttttatcatccaaacatctactccatcaaaatccaaatgatttttacctgcttttaagatagcaagtttatccaagacatctgataattttactgtgtcatattcctttgttttagttatccacaactcaaataaaaaggccttattatcaggtagtttgtcgaaatcttctatagatgtatagagcgcatgtatatctgccggcttaatggcgttgataggttcaatcaagcctgtatttttaggtttgcctgttttcgtattatacttttcatcggcatactcgtctgccttcttgctcagccaatcttttttctcatttttgatatatacggttacatcaacatttccgtcacttttatcttcagagattttcagaatggatgctccactactttgggctaacttttggggaaccaatttgggagacatgtcaaggtttatatacacaccatccgcagacggtaaaccacacttttccctttcagaaagagccgtgatggcagattcaacgactgcattatagctttccttgataaatgcagcatgttcttgtctgttcctttcaggaataacaggtggtggtacaacctttgctcttggcgtgaaagaacggggttctgctatttggttacctaagaaaaaatgttccttttgcatattatctccttattcaacttatttcacgacaaagttgattccgtttgtcaacgaccatctttaccaattctatattcattggcacatcatttaacaaagattctttgaatatatcagaacataccatttttatctctgcatggctcataccttcaaacagaggtgctgccatggaataatcaagttctttagccgcatatagatattcacgcaacagatgaatacgttgtctggagtctggcaagcgatattcaataacgtcatcaaaacgtcgaaacatcgctttgtctatcgaatcaatggcatttgtcgctgcaataatgaaactgtctgatgagtcacgttccaacaattgaagaaatgtgttgagtattcggcgctgttcacctacttcattttccattccacgctgagcaccgatagcatcgaattcatcaaaaagatagactgcaggaacctcatctataaaatcaaagatacggctaagtttctgtcctgtctcacccatgaattttgtaacgactttctctgtcctcacaataaataaaggaagattcaactctttagccaatactcctgctgtcatagtcttgcctgtcccaggtacgccatagagcaataatttgcggcggttggcaagtccatatttcctaagttcttctctctttgtaaattctttgatgactctttctatcttttctttcaatgctttgtccgtcaccatatttttcaggcaatcgtatgtctcgacttgaagcaataagtcatccacatctttattacgtggaataagctttaaagcactaaaagatgtttttctttgacttaaaagctcctggatggttcttgctaatactgcatgaccattctttgcctctacagcagaaatctggagagcaacttttctaaattgtgcatcatcgttattcagatgattacgtatcaaagacaatatttggtctgcatttgccatctataaatcaataattattgatttgcaaaattactattttttcgtctaattccctaatatattatcaaatatcaccaatgtcgccaaactttttgaggaatgtttatagtttgtataacagatttatgatttaaggagtgtatgtaaaacacacaaatagtaatggagatgataaatcatatggtaacatgtttttatattaggttgcttgtcgtctgatgacttttgatgccatctgatgacactgttttgtctgtttcgggtataaagcggttctttgtcctatgtgttaatcgtgaattaattcatgaaaaagatatgtcatgaacatgcaagaagcaaagaacatcaggcttgttgattttttagccggattcggacatgaaccggtaatgcagcgtgggaacagcgtatggtataaatcgcccttcagaacggaaaaggaggcctctttcaaggtagacctccataaggaactgtggtatgacttcggactgggaaggggtggggatattataacgttggccaaggagatttatcggacacaggacataagccatgtgttacggtgtattgaggataaaaggacggttttgaaaccggttactgtatcctgcccttttgaaaaagcgtatcccgcctttcaggacttgaaaatcactcctcttgccaaccggatactgcttacctatctggaggaaaggtgcattgatacggaaacggcccgaaaagtatgcaaggaggctcattttaatcggaacgggaagaattattttgccatcgctttccctaatatttccggagggtacgaaatcaggaacaggtatttcaaggcttgtatcgctcccaaggacatcacctgtattattagcacgccggagagcaggatttgctatatttttgaggggtttatagattttctgtctttcaggctggcttttccatctttggaagagggggattatatagtgttgaattctgtcagtaacttacagaaggctttttctttcctttcacgatatgacggcatctgttgctgtctggacaatgataccgccggaaaaaatgcggtgcaggcattaaaggacaaatacggaatccgtatatgcgatctttcgcatgaatattccgaatataaggatctgaatgaatatctgtgcgggaaaaacaatcagctccatatataatagaggtattgaaaagactgtttgatgatatatccttatttttatcctgccgcatgtggcaggaagcagggtgatttttaatgtggcgatactgtgttaatagtagaatgtggtcagatgtgttttatgatcttttacaatctttactttctgcatctgtccgtatatttcacgcacggataccggacagttcatcttttcccactcttccggggaaatcctcatatcggaatgcctgaaacatagtatgaccatctcctgggaatcctcttctacgaatatgaaaccttcatggtcattgacaaactgcttgagtccatcctcatccttacaggatatttctccgatgtacatatccccgcccgaccgggtgtttttgcggatatggattttgaaccattcctgactttccggctgttcaggtgcgccacattcccacagggctactttcgcatcgtagtaaacttccccgttttcacatgccccgtaatgtccccagtgcttgaaacggccggtagtccaagtcttgaaccttacatcaccggtctttatcagcacgcactcgccgccatgcatatcgcatttgatgcccttcttatcccaggacacgaatgggacacgggagaaattccggagcacaatgttatctccatacacggcatctacgaagaacggccgggaacgttcaccgtatccagaaataaagaacaggctgtcacctgtacggggatatcggttggaacgtgttttttcgatgtgttccaccattgtgttcactttctctatgtcttcccggacaagcccgtgtatccggtcataccagtagttcaaacggatgaatgtttccttgcaatacttgttttttgtttgaatcatgatcttttttattttatggttaaacatgcccggctttggtaaagccggtatttcttttcttacatgcatccgtttgtcttttgccctgattgtgcaaggcttggcgaaaaaataccgcggcgaagcgaggatgattttttcagccaaccggtccgaaggaccgccttgcacgatcaagggcaaaaggctacctttgcaggtaagaaatagaaatgcggaacattgcttgattctaaggtggaaaaactttaacccgctaacctgatatatctatcaaaaattctttgctatcctctgaaaaatgtaatatttcccttggattatcatcgaaaaagtgtgttatatattggttcctatcctcgaaaaaatgtatctttgcaagaaacaagtgaataattcttattttgaaggaatcgatgaaacggaagattatacaacagttgaaactttggaaagataatcctgcgagaaaacctttgatactgttaggtgctcgtcaggttggtaaaacttgggtgatgaaacattttggtctgactgagtttgagaacgtagcctacatcaactgtgatgtcgagccactggccaaggagttatttgcagccgactataacatcccccgtattttgctgacacttcaggctatcacaggaacgaagattgaagcaggaaaaacgttgattgtattcgatgagttgcaggaggtggaacggggattgcatagcttgaaatattttcaggaaaatgcgcctgaatatcatgtgatggcggctggctccttgttgggaattactttggggaaaggtcagtcctttccagtgggtaaggtaaatgtaatgcatctatatccgatggattttgaagaatttctgatggctgccggcgaaactgatttgtgcgatttgttgcatcagcccgattgggaaattttaaagattctcagtttaaaatatgttgatttgcttcgccaatactattatgtaggtggcatgcctgaagtggtggattgtttctttcagcatcaaaacttgcaggaagtacgtgacaaacagactgaaatcctggatgcttatcggcgggacatctccaagcatacgacacctactgaaagtatacgtatcggacaagtgctgcaatccttgccttcgcagttggccagggagaacaagaaattcatctataatgtgttgaagaaaggagccagagctacggaatatgaactcgccattcagtggctgatggatgcaggtctggtacataaagtcagccgggtaaaagagctgcagatgcctgtcaaattttacgaagatctgggtgccttcaaattattcctgcttgattgcggtcttttaggttgtatgaccgaggcgcccgccagccaaatgctggtaggaaataatgtattcaaggagttcaagggcgcttttaccgaacagtttgtcttgcagcaattagtggcccaaggcttttcgccctattattggagcagtgacaaaacacctgcggagattgactttgtggtacagacggagcatcgcgtgatacctgtggaagtgaaagccgaagagaatgtacgtgcgcgttccatgtcggaatatattaaaaaacatcccgattatcagttgaaaggactgcgcatctccatgatgggttatcaagatcagggttggatggagaatattccgctgtttgccattacgaagttctttggatgaatggtacttttatggatatgagatacacctatgaagaacttcgggaggcttatcaaaaccttctgaaggagaacgctgttttgaatcaggagattcagcgcctcaaaagcgggaatgcagggggagctgtcggatgtagcacacttctcccaaaggaacagccagatgtccgcctgtctttagaggagaaggtagctttgttcaggagtctgttccgaggtagggaagatgtatttgcccgacgttggtatagccgtacgtccgacaagtccggatatcagccggtatgtctgaatgaatggaatcgggcatactgtgacaagaagaagtttaagtgtgcggaatgtccccaccgccaattcaaggcactttcctatgaggatgtgtataagcacttggagggaaagcatccggaagggggggatgtaataggggcatatgctattcttcctgataatacttgctgcttcttatgcgccgatttcgacgataaatcctgtgtccatggctatcagactgatgtattggcctatgtgaaggtttgcaagtcatggggaatacactgttatatggaacgttcccgttcaggtaatggagcccatgtctggattttcttcgggcaacctgtacctgccgtaaaggcaaggaagttaggctttgccttgttgactcatgccatggagcggaacgtgaagttgactttcaagtcttatgaccgtttatttccgaatcaggattatctcccggagggtggattggggaacctggttgctttgcctttgcaggggcaagcccgtaaactgggcaatagcgtctttgtcgatgaagactttgtagcctttaaggaccagtggagttatctgcagcaggtcgttaaggtttcagaggaggaagtggatgtccttcttcaacggaaagggctctcaacggatataggcggattatccaccaccagtgagaatgttccttggaaagtgcccgaagtgcaggctgtcacccgatatgatttccccaaaacaatgaatattgtccgttccaatcggatttatgtgccgttgaagggcgtttcagggaaagtgctgtcacatctgaagcgggtcgcttcgttcaggaatccggaattctatgctaaacaaggaatgcgcctttctacctataatataccgcgtgtcatttcctgtgcggaagttctggaggattatctggcattacctcggggctgtgaggatgcggtgttggaactgttaaatgccaatgaggtagcttattccattcaggacgagcgggaaaaagggcaagttcttatggtacatttcaaagggcagttacgtgaagaacaagccgaagccgtacgcatactgatgcagcatgatcagggtatcctgaatggaacaacagctttcggcaaaaccgtaacagccatcggcctgatagcagaacgtaaggtaaataccttgattctggtacatacaaggaccttgctggaacaatgggaggtgcggttggaggaatttctggagttggaatatccggtagaagaagccgttccgaagcggggaaggaaaaagtatttttctccctttggtacgttagattccaaaggaaacagcttgcatggatgggtagatgtcgccctcatgcaatcctgcttgaccgatgagggggtaaagtctttcgtccgccggtacggcatggtgattgtcgatgagtgccatcatgtttctgcggtcaactttgagcaaatcttgaaatcggttcctgccatgtatgtgtatgggttgacagctactcccattcggaaggacggccatcagcctattatttttatgcagtgtgggccgatacgctattcggcagatgccaaaagtcaaataaccaggcagactttcaagcgatggctggtgcctcggtttacagcgtgccgggaccttttagatgaaccgccaatatacgcgcgaatcgtacaatcccttgctacggatgaacagcggaatgcacagattgtggaagatgtgcgtatggttctggcagacggacggacaccgatcgtgctgaccgcgctcacttcacatgtggagcggctggggctgctgctttctgtatattgcaggcatgtcattaccttggtgggtgccgaatccatgaaggagaagcgtgaaaagatggaacggttggcagcgcttcctccagaggagcctttggtgattgtggcaaccggacgttatgtaggtgaaggctttgattatcctcgtttggataccctattcttggtttctcctgtttcatggaaaggcattgtggcacaatacgccggacgtttgcaccgcgagtatcatggaaagactgatgtccgcatttatgattacatcgacattcacttgccattgtgcgaccgcatgtaccagcgcaggctgaaaggatatgcggctattggctatcagttgttagagaaaggagtgcttgtaaccggtcatcatacgcaaagtatattttcaggtaataactatctgtcccccttggttgaggatatagctcaagccagacataccgtaattatctctgtaacgaaaaccggattgaaaaagcgttctcaattaggaatcgccttgaaggaagctatgcagcggggagtacaggtggttgtgttcgtgagaaacaagactgaagaagcagagtggttgcaaagggagggtttgacggttcgtgtatccgaacgtttgacctttcaattggtgatgattgataaaaaaaagatgtggtatggcagcatcaattatatgggttatgccacggaagaagagtgcgcagtaaggttttctgatgaacacttgacggcggaaatgctggatgtgttgtatggtgagtgagcagattttgggaggagagagtttgcatcaacaatggtaagtgttatactgatgagaaagttactcatacaagatgaccgatttatcatagccccataaagtttcggcctgttatatcagaaattcttgataataagtgacattatattgaagattaaagcgtaattatgatgcgttatcagtacaatgacagttaaaaatagagatcgagaaagaaaattatgaaataattcttctaaaccgcttacatgctcgggcacaactgggaggcgttttttgaggaacacttatacttttccatgctccgcaattggcataaccattacggttagcccactggagattgtattcgcattgaaaacaagtgcgcgacgaagggtctgacaatgcttcctgctcatcaattattctacgtttttctgctaattcagctttacgtttttctatggagattttcagctcttcttcctcctttttctttcttgcttcagcttctgacctttccttctctttgattcgttcctttctctcgttctcggatttaatacgttcatattcttgctggtaattttggaataactcagacttgcagagcctatatttatgtccgctttcttcaatgactaagtattgatttatacctgtcaaactgtaaacaggaacacctgcacaatggtacgaacatcccaattcacattgcctgcattcagattcatcaaccacccgtacgggctttccggccttgttgtacaaagatcctacttgagaaaaataagtcacgttattcatccatttcctgtcctttgaagaagataacagaaaagattccagtgtttccagactttggttggaaaggtctatttccaagcaattcatgttcttataatcaatagcggtcttgtgttggatcttgtactggaaaaggaattcaataagatattgctgaccttcttttgttgtcgcaattacgtccggttgtttatctgcccgttcaaagcaactgtcaattcgtacatcaacgaattcaatatccatttcaggaaatattccataataagaaggtgcatgaatacgttttgcgttttgaataatctgctctgccaatttatacatggtgaccacatagcatatcttaaggttggctccacgtgtatcactgtgatgggcaaaaccgtgctgtctcacttcaccgtgacgggcaagcaagcgttcgtgacaataaggacacttgcatccgcattgaatacctctgggcacgttgtcaacatggaccatcttgccttgttcattttcagcccaggagaaaacaaagtcaatattcatacttcaagatttatgtttaatcagtcaggattgaactttggataacttttccagtaaagtccggcattacgtcatacattttgccggacaattctgactgtttgttgaaagaaatgcatccatattcctctttggagtcgtgaaagacaccaataatctgctcgatgtatacatcggcggattttttgtttatgaaataggcatcgaattcctttaggaaccgggccttgacaaccggtctacatattattttctctaagaaggaacgcaaatccttttcgggtatctgctgtaaaacctcgattattttttctttctttatgctgtttttcttttttgccatgttatagtgtataataggttacagttcggtttttggctttccatttgacttgtcaacacgtaattatgacaaagataagtcttttgcttctaattagcttctaaaaaatggtatatttgcagactgattgtttgaaaacagatgtaaagtatggtacaaatagaaaagaagatgtaatgtttaacggaaacatgagggtaagccaaccgcatgcttcaaaatattacatcaaaatgagcagatcaagaaaaaagttcccggctggggttaattgttgctgcaagtctcagaagaagggaaagaaagtggcatccaagcggttcagacgaaaagtgaaagtactgatgcaccaggaaagttatgagcgactgccttttttctccatcgaattgacttctccgtgggatttgggtggagacggaaaatctttctatggttttcgctccgagtgtgactggtatgaaaaggtaatgcggaaatgacggaaagctttgattccacggtaaaaagctaccttgttcataagtagtgtgcttgctagcccaactttaacgccccgaaaaaggctgatttttcggggcgttaaagttgcaaaatcgttgatacctaatatttcatttttctaattaaacatgtctggcatttgtgaacatgtggggttatacatcaaaagcttccattctgtttttttccaacaaagcaaggatgtccttttccttgtataatagtttgcctcctattttgtagtaaggcagtttgccgtttattctgtactctgccagcgtcctgcgtgtcagtttcaactgttcggcaagctcacggtccgtaatgtaacgttctccgttcagaaccggacgtaatttctcctcctgcttgtccagcatttcggacaggctgtctatgttccggaaaaaacgaatgatttccggggtttctttggttaacagggattgaatcatagcacttctaaagggttatacggtgaatattgttttccataaaacggataatatcctgacgcttgtaatacaccttacggtctatatgactgtaagggatggcactgcttctgcgaagctgcaacatctttccgggagagacgtccatgagcatgcaagcctcctggttgtcaatccagtcgtccataccggatacgcaacttccgcatgtttcacacattttttttacaacggcttccagagcctcattcatttccatgaatgttttagcctcgatacatacaaactccataaacttcatttttgtcggatacgaaaatatgaaagggaatattcatgtccaaaaggatgtcgtcaaatgacatcagatgtcattaaacgtcatatgtaacaaagggttgcaggggcaaacttcaggaaaatgctctgaaataaatattatcaaccatatatgttgaataccttgtgtggaaacatcttcagtttacccggttttaagaatataggcggagtggtatctgtaaattgtaaagtttacattacggactttacagttttacacttcaaaattttacgcttaccatccactgataaaaattacgcaatactattcacttgattataaataagatgtaatatgcaattaagttaataccggcactccggcatagatttttcactaaagatggcatatactctcgaaagtgcgcacaagaaagggtatttcagtaagaacctttaaaagacaggagagatacgccatgatgtatatagacaatgaagtgcttgagaaaatgataatgaccatagtggaaggttttgaccgcatagaaaagaaactggacaggatggggcgtgtgaaggatttcatgaacggggacgagctgttggacaattatgacatagccaggctgctcaacgtgtcgttgcggacagtcgcccgttaccgggaaaaggggctgatccgctattaccagacggacgataacggaaaaaacttctacagaagctcggaaatacaggaattcttgctgaaacgcggaaagaaaaaatgagcgtgggagtatcaatatgcggaagttatgctaactttgtttcataaacagttgttatgaagacaaataccaattccagatatgccgttgcggtccttattgacggggataacgcctcctttgagaagatggaggatataatgggctttgtttcccgttatggggatgccgttgtgagacgaatttatggagattggacgagaaaagcgctttccgcatggaagggaattgcccgggagcatggattcaggcttgtacaggcttcctcccatgctcccggaaagaacacgaccgatatcgcgctggtcatagacgcgatggacattcttcgtgacggtcgggcggactgtttctgtctggtagccagtgacggtgactacagcctgcttgcccaacggatacgtgaggccggattgaaggtgctgggatatggggaggataagactcccgtatcattggtgcggtcctgttccgtgttcctgtatgccgaccggaaggaaaacagggtttcggacaatactcccgaattttttatccaaagggacatggagtattttgacaaggcttttgagcaagcggctgacggtaaaggggaggtgtccctttcgctgatcggcggcgcattgaaaaaaatgatgcccaaattcaaggtcagaagatatggatgcaagacattgggcaaactttatgaaaggctggacaggtacgagctggtcatgacagacaagggagtggcaagtgccgtgcggctgaaagactgaaccgcatggcgggaacaatcaggaaccgtcagtttccttttatgcatggcaaggatgcataaaaggaagctgacggttgttgtctataccggaatgggattaatccgtagcgtatcgagattgagatagacaccccggtagaatgtccttccttccctgagcatacgccacaggatgtcgcagccggtttgtgccagtatggaattgatgaaaaggtcctgcttctgcaaggcttccgccagcgagcagctcggtcccgaatccttttccttgatggtggagtagcgtacctcttcggtaatgacgttcatgcggggaatgggcaggtactcgttggagacgggctggagaatcttgccacggatgttccctatcaggacctgtccggtggtccgggcgttgccgaagtccatccagtatatgggcgaccgctcgttgttggaagtgtgttccctgtgtttcttcaggaaccgccagaggttcatcctggagcgggtgttgtcggtacaggtgacgatgatgttcgccagggcgggttcttcccggtctgcggaggctttcagcggataacgctgcccctttgcctcccacgagaagccgaaaaaacggttgatgcgggtcgcgagtgccgctgccttgttcaatccgagttccgatccgctgaacagctggcgtccgatgttcgcttccgtgacggtatcggggtcaaagaccgtcacgtgcagtcccggatgtcctagcgcctgtaatgccacgctcatccgcgccaggccggtggccacctgtgagcctgttccgcccgcaccgattacgaagacggtcacgggatggtagggattgagcaggtatctgtctgtataatgaatctttttcatgccagtaagtctttaagttgtttgctcatgggtttcagttcgttctcgtcaaacggattggcgcgtgtcttttccgttaccgagaccaggttgcttccggtcgggttcctgcttcctcccagatgggagaactcgctgagccagaaacgtttttcccaatactcgaggagttttgagaaagtcatgtcttccgggggagtcaacgcggcgtttcccagacagacactgctgcccgtgacattgaagaaaggggcgaggaaaagcgggctgttctccgccggtttttcccccttgtaggagaaaatgtccagcctgtcaccggaaaccttgtagatcacgccgggcacatggaatgtcccgtcaggaatattcaggcttccggcaaagaacatccgccgttttcccggaggattgtaccagatgtacctctcgtgccccttgcgggtatcacaccacagcatgttggcggggattttcccgtgcggcacgttccgcctgtcatccgtataggattccaccagggagtccatgaactcataggtgacaggcatggcagcctccatcctgcccctgtcattgatgggatgcagttcgaggtaatgcattccgttcccatagcggttctcacggtattcatacgcgatcagtgccgccttgggcaccatcacctgttgcaatttattggtcagttcattcatatcgttcattttagaagttgtcagctatatgttttgtaaaacgtgccagccattttgaaagcttttccgggtagtcgtccatttggaagagacagtccgtttccggtgtaaggaacctgtatgtgaccggtgtaagggcataagtctcctggtagtccgagttcatgaacccttccatgcattcagccagcgtgtcgcgggtagagtagaccagcatgacctggctttccattcccaccgggtaaaaatcacgctcctcctcatacgcccaatcgtacaggtagtctgtgaggttcgggctttccggggtgatcagtgccatgccctcccttatcaggtccaacagtttttgctccttctccttttttgtccggtaattccgtacagcctcttccagagaattgcagaacggttttcccgacatccgtttgagcgctttcgcccgttttcctgactggtaggaatccgccagtcgcctgttcgccctgatttctttcggggaagcgtcggaatcccggttttcccagtcttccagttcctctatggcgaagtcatagcaaaacgcctcggtgacattgcagactccgtgatgccggacgaattgccggatgaactccttgacaatgttcctcaatggtacgggaagccgttccgtaaagtcgatgggaatccagaacagctcgggttccggccagtcgtgatggcggaacagacagaaatggagccttccttctttctcttccagattgacacattccggcacgctctcgtccatcgccttgtacagttcggtgattttcagacgggggctgccccctttcctgtatcggaaaggaagctttatacccataagtccggcatagttcgatgccgattggtagagatagtcaaaattctccggtgtcgtgagattgaccggggaaccgtcatatccgtctttatgccagaaatccggtgcgaggggaggaatcttatctgtcagaaaatcatgacgcttcccggtggcggcagtatcctccttttttgtcccaatgttcctcttcggatgtctgacgggccggccaaacggataatgagtcctgccagattctccttggctgattctgagagctgtctgcatggtttgtcctcctttttctttctcttgtccatacgattatcctttcactccgatggttgtcttgaagcggtagaccgccttgtcctcctcccattccggtccgtgaacggtcgccgttgtcagttcgggataggtcatggagtagaagtccatcacctcgtttacggacagttcgttgttcgggtcgctcaataccagttccttagagtccttcttgaatttgaagactctctgcaatcctttgatttcaagtgccataatttctcttcttttataaggtttaacaatataccatgtccatttgtgccatgtccgtcatgcggcattccttcgggaagtccggatattccgcgtacgggtcttccctgagcagttcccggtcatcctcgcagtccttgtcgaagttgtacattgcagcctcttgcggttgccggaggtattcacgctcctcatgagttcttgcggtctcctgcgccggtgcatactgtgacgaggccggttgcatccattgctttccgtccatccgtgcctgtggcatctgtaccggttgatggaattggattccttgcggttgtggaactgcctgttgcgggaccggttgcgcttgtggtgcggaaatagtatattgtacgggttgtgtttgcggctgtccggcaaatggtgtttgctgtcctgaatgtacagccggccggggcggttgcggttgtgaaatgggttgcggaaccggagccggctgctcgggcaaaaacatcgggatttgctctccgcttcggtattgcgatgtcggggctgccgccggttgcggcttgggcattggcggttgttccatgccgaacaggcttccctccgatgcctttttctgtacctccgccatcttctcgtcaatttccttctgcttgtccggaagtgccagtatcctagcctgcttgagccatgtcaacgcttcggaatagcgtttgccggtcatggcatcctccgccttcttaagcagcttttccatcttttcccgtttctcgcggacctccttggactctttctcagccgctgacctggcggctttgctttgtgaggccgcctgttctgcctgcttctcgaacgcttccaggttggtaaggatgccctgcgctttctgtacgggcgtgccgacagcctgcaggaagcccgcatccagctcttccggcgtaccgttcaggatgagcgggacgatgcgttccccgtcctttacccccgaccgtctgggaacaacggccaccgtcagattgttgtttactcgtctgatgttgatactcaggtctgtgcctgccgtgatcatttggttgattgcttgaaaaaacataatggtaaaattttaaatgttatacataggtttccttgaaaaaatcctttaggattctctgcctgtccggattcgaggcgatgcccctcaacggttccagatagtagccgatacgtttcggtccgtctgtcgtatcgggaatccgtttttttacaggtctcacacggcttgtggcgggccatgcggccggcatggctggagccggcggggtgaatgcagctgttctcatgcctttatgctttaagggttatacaagcatgcccatgacggtcagggcgataattatttttacaatgagggtgaacgtcctgaaaaggaggctgatgagcgttcccgacaaaaggaacaggacgagcagatacacgggaatgattcccttgctgtagagcaggcatattcccgtaagcaggaccagtgagaccgtccgcttgcagatgttttcgataagtcgcagtttcatgtctttaaatttttaagaatgaataatcccatcgggatatgttttcccgattttataggcctccggcccttggattgcctttttgcgcaaggcttggcaaaagaaaataccgcagcgaagcgaggatgattttcttttgaccaaccaagcccccaaagggggccgccttgcggcaaaaacgaggcaatccaagacctttgccgcttaaaatcggaaaaacgtatcttgcacatataaaaaataaaaaggaagtacagacagacgtctgcacttcccttgtcttgttggctttgacatttgtttatatggttccctgtggccgcttttccaccggatggttccggaatatctcgcctgtcacctcatttaccgtttccagcacgccgtccaggaactcttcctgcgagagttccccccgttctatccgtgccagttcagtttcccagcccgaggtgagggaggcgtcggccaccttcataccgcgtaccgtctcatacaggaaaagccctttaggggtcgggacgacatatttacccgaataacggatgtatttacgttccagcagcgtgcggaggatattcgtgcgggtggagacggtgcccagtccggccttgtccatgtagtccaccagttcctcgtctgtataaggggagaccggtaacgatttcttatgtataaggctgcaccctgccaccggcagtatctcttcctgaaaaaattccggcagcatcgggcagggcatacagccttttgcgacaatatgttccctctcgaagattccgagccatcctttttccaggatgcggtatgtacggatgcggaatttacgtgcggcgcacaccgcatcgacggttgtgtattccaccttgcagggcggcatgaacgtttcaagcaccctgccgacaatgagcgtgtaaacctgcatttcctcccggcccaatttaccgggctgtatacctgtaatgatgatggcatgatgctccatggtgtcttgtgccccaatgctgtcctgcggcgcggcaaggtcaaccataccggcatattgtcggaactccttgcgggagagcatcttctccatgacaggcggcaacgtgtcatatacatcccccggcaacaggcgactggaggtgcgcggataggaaatcagcctcttctcgtacaggctctgtgcaatctcctgcacctgtatggccgtcaggccgtggtaacggttcgcgtctttctgcagttcggccaggttgtaaagtgccggtgccccgatttcctccgtccgtttccttaccgctgtgatgcgggcgttctttgccgccttgcaatcctcgtacaatgccagtgcctcccggcgggccacaaggtcgtccacgtggcgcatctttaggatacggtcattcttgcataggctgatgaatacgggccagctgtcagccggcatgtggttctccctctcccggtaccgtctgcatatctccgccagtacgggggtctgtaccctgcccagcgagttgttcccgaagcctaccgccttgcagatggcatggcttgaattgacgcccaggagccagtccgcccggttacggctgtccgccgccaggaacaggttgtcgaaccggtcacatggaaggaggttcgccatgccttccgtgatggcctcgtccgtcagagacgagatccagaggcggaggcagggttgtttgcaccccagaaagccgtaaagatggcggaacagcatctctccctcccgggaagcgtcggttgccgcgatgatggtgtcgcatgcgttgagtaccttggctatcactttcaactggagcaccgcattgatgtcgggattccacccggtatccgtcttcacgtgccttactgtcaggacggaaggcggcagcaggggaaggtcctcccgctccacacgggctgttcctgaatccttcggcattgccagggagagcatgttgccgtatgtccatgtcaccatgtagccgttcccggtcatatagccgttctcctttctgcctgctcccaacactcttgctatctctctgcccacgttgggcctgtcagtcactattgcgatcatattctttttctttttgatgccccgtaccggattgggcgatacggggacatgttaaacttgttttattttttgttatttctttggagattcctcctgacggatgccgttgatttccatgattggcctgttgttgtcaccgggtaccagtttgaatgtggcatccatggccaggctgattaccggggtacggagtctcaacgggatgatttccgactccttgccttgcaacaacaggtcaaggttgccgtccgcttccagttgctccttgctgatacccacggccttcaggccgggccagtcaatgtcttctacattatagatataagggatgttccgattcatattcatacggttcagggatttgatgtttgtaaaactgattttgtttctctccgatcggggtcataccgcttgttttgcgccattcttttgttcctgctgctggccttgggcggtgtccgcctgtgccgcacgacgggaagtgtccctgcggatatccgggttctcctggaaatactgcaactgcccggaataagggtttactttcaggtaggagctgaacgtctgcccattgtttttcagcccttcgacaaggagggtcttcccgtcctggaggtttgccttttcctgcgccgtgaacacatggccgtaaacctccgccgggatacgtggcgcctgctgctcgttgaacccgtccggcgtgcgtgagtacatcgtcctgccggtattcatgtccagcttgacaaacgcggagaattcctctcccttacggttgatcatgttttccagatagacggcctgccccttgcgtaaggtttccttatcctcgggggtcagttgcacgctgcatatctccttggggatatagatttctccggtttccggattatgacgggtgtaattcggccgtcctgtcgtctggtctatcgtgacaaacgcggagaaagccccatccctgttcttgaacttcatgtcctcgaccaggatggtatgtccctcgctgagcatctttatctgggtgggtgagagcggtacgcccccgatggatttctcgttgaatacctggttcttcgggaagatgaactccagccccctgcgctcggcgctgtattggagcgtggcgtcaaattccttccccgtcttggaggtcatcccctccaccttgacgggttgtccctccttcagcagtctgatctcctcgtccgtaagtcttaccccgctcacttcctgcgggatgtagacatgctcctgccggacggcgaccagctcgttggtgttcttgtcgatggagatcaggcagggggtgtactcactgccacgcaggttgagttccaccgcacgtcccatgttgccggtctcacgcaggttcttcttgtcctcctcgctgaagttgaatccgaaataagggcgttccaactgcggttccttgcgtatgccgtgaatggccagtcccacctgtccatcctgttgcgggatgagtgagagccttgcatccagtttggctgtcagcaaaccggaaagatggattgtcaggggcaccagcttgttggtcttgtagcccttcagcatggaatcaaggagtccctgctgttccagcgaagcctttgagattccgaccttttccaactcctcccagttgaccatgttctcattataccggtaatgcggtccttgtgactcctgcgctgcctgttgagcctggggctgctgctgttgctgtgccgcctgctgtacctcgctctgttgcaggggttcctgcggttgtgtctctttgtctaccatagctgttttttctttttggtttacactttgttccttcttgttttctctcggacggatttcgtagcgtttgaggaactccttcactgcgtccgtctttttcccttccgccaggtccttgatcgcctgcttgttcaccttgtagtcgtggaaggtcatgcggagcaggcggaaatgggtaggttccttgaactggctccagaaattcttgatgaagttttcgagtatgctcgagttcttgtcgaatttcaggaatgagttctcattcttctcgtccgccggaaccgtcttgaccttcccgtccttgtcgatctcgctgactacttgtacaccggctttcgggtcactcttgttatgaaccatcatcagctcggtgatctgttccaccaaaggggcgtcgttcacggccttcggtttccgggttcgtctaggcttcccattcgggctcttttcttgtgccataccttttctttttggggttaataaattgctttgacgcttcaaatgtatgggctaaatccgaataaaacactgattttcaaaaaggtgtcatcagatgtcatcagatgtcgtcaaatgtccgaaagactggttttccgtgagggaaacatgccgtgaaaacaaggatatggtatgcggaggaagggcgaagaagccggcacgggcgcaaagggaggattatgcagagcagagggagctgaagtccctgtcttctcatggggcggcgtttttttcataagacattgccaggcctacccatatatcccgtacttcctgccggatttattagggatataaaggaggccctccttttttcatcaatgacacggtcatgcgtcgcgtcggtcgcagtgagtccctataatctttcccgaaatcaaaaccattgtccgggcgtttgtttccatgtgtattttccgcgacttgtcgcaaggaaaatactcatggaaagcgaagccggaacgcccgtgacaatacggttttgatttatctttgattatagggaactcgctggtatccgcctgtttttcacgaatttcccagaaaacatatactgtcttgttgtttatgcgatataaatatttttggacttgttccacggaaaaaccgtcgcttttcattttcggactttgattctttacgaggctattcggactgtctttcaagaagatttacagagtttggcatcggcatcaggtgatattcggtgttccaagcggagaagcggaatctaggactaaatattattttcttccttcaacaatatagcccacgggttgtatctatgtacctattattcatcataaaacagactatatatggctaccattaaattaaaattccgtccatcgacggtacggggtaaggccggcacgctctgttatcagctttgccaccgtcaggagaacaggcagattaccaccgacatgaggatatttcccgagtggtggaatgagacgaaacgtgagcttgtcgctgtccccggcaatgagagggtcctgaccgcctaccggaaacgggcggaaaaggagatgcgtgacatccgtgagattatccgcgagctggactgtagcggagaaacatacaccttgttggaaatactcaaccgctatcgctccctgccttccgagcccggtttcctatactacatgaaaaaagagatggaagcgctttgggagaacggccaatacggtacctcgcgtaattaccggcgtgcactgaacagcttttccgctttcctggatggtgatgacgttcctttctcattgttggattccgccctggcgtgtcggtatgaggcatggctgtggcaacaaaaggtagcgaggaacagcagctcgttctatatgcggattctgcgtgccgtctataacaaggccgtaaggcaaggtcttgcgttgcagactttcccgtttcgtgaggtttatacaggagtggctcgtacaccgaaacgcgccgtggatgaggaaaccatcctgaagctccaaaggattgacctctcggactcaccggccctggcactttccagggacatgttcgtgttcagctattgtgcccgtggaatggcgtttgtggacatggcatatctgaaaaaggagaatgtggacagcgggcgaatcacctattgtcgtcataagacaggccaatacctgacactccatatcgaaccgtgtatggcggcgatactggaacgatatgggcgggtttatccggaaagtccatatcttttccccgtccttacagatgaacagccggatcaggcttaccggcaatatcggaccggattgaactaccataaccgaaagttgaaacggttgggcaaattgcttggcgaaccattacctttgtcctcatatacgcctcgccacagctgggctaccgccgcacgcaaccacaacgtaccgattgccgtcatcagtgcggggatgggacacagcagcgaaaggactacgcttatttacttggattctttggacaatgccgtgatagataatgcgaacgagaagattttgaagggtttgaacgataccatttctatgtaagagagggtaaaaacacactgcaaaggtaatgattctcagtaaaactgaaaagtaaaataaacgtttttatttccttattttacccccccatttataaatgactgattatcaattatttgcattactaatttaatataaatcaaaatagtaccgtaataagaatataaaataaaaggagaacgttgcattatcctttcgagcgtattttcgagtctaaaaccgagcaaaccgagcaaaaatgtacttttatagcaatgtatatgcctaattatcagcaaaaacaacatgtgtaccctctcttacatagaaacggtacgaatacggggttacggtatccgctcactgtagtcaggagcggcccgcattccggaagtcctatgaaggaaaaaaccggattaaccttgattgctgtatcttccttatttgaaaaagcagaaggtgcaggaatggaaattatatcctttttatcaacccggtaacattacttttcgttgaacatagaaacacacacacacgaacattggttcgccctaaaagtattttataacaaagttttcgagattgaggatatattgaaaaaagacaagatcgagacttacattccttgtgaggaaaccttgatggaacgtaacggcataaagaagaaactccgtcgtccggtcattaattcgcttatgttcttccgttcaaccgtttgtcgtgctttggaagtacagcgacaattcaccaataaggtaatcctatatacaagacagaagggattgaaaagacttccccttgccattcctgatcgggaaatgaacattttcatgctggtcacctcgtccggcgagcagggaatggaatatttcggggaggacaattccaagtttcaacagggagaacgtgtacgggtcattgacggaaagttcaagggagcggaaggggttatctgccggattaggaagaatcgccgtttggtggtcaccgtccaaggcgtatgcgccgtggctacttcctatattccacaagcctttctacaacggatagggcaagattaagaaaatcatcaaaagaatcatatagtggacattcttcattttatcgaatttgcctttatagtcatagtcggctggacattgagtgcgatggtcctgcctcgcatttcgttggtctctttccgacgtcgcctgttcgactcagtggacgaacgtaagttgcatactgcccatataccaaggttaggcggtatcgcctttttcccttgtatcacagttacggtttcgcttgccattatcggttacaacctttggcagggctataacatactcgacatggacttgacgaaccgtctgctttccatgctctgttgtctgttcatactttatcttataggtatgatggatgaccttatcggtgtacgttaccgttccaaatttgtagtgcaaatactttgtggcatactgttggtgatttccgggttatgcttcgacaacctatacgggttgttcggtatttatgtcataccttattacataggagtgccgttcacagtattcgtcatcgtctatatcctgaacgccatcaatttgatagacggcattgacggacttgcctctgggttgagtattatctcattcctcgctttcagctgcatgttcatccatttgcaatggtggatgtatgcctttatcagtctagctgctttcagtgtgttattgccgttcttttattataacgtatacggtaagatatatcggggacgcaagatctttatgggtgataccggttcgctcactatcgggatgctgctggcagtgatggtcatccgtctgagtatgtccgatccagtgaaagagagtgcctttcccggtagcattgtgatagctttttcttttttgattgtaccaatgtttgatgtgatacgtgtggttattcaccggttgcgtaacggtaaaaatccatttcttccagaccggaatcatatccaccataaatttatagccttaggaatgtcccaacgtaaagctatggtaagcattattattatggcagctttttttgcattgggaaattgttttttgattcattgcctttccgtaacaaacttgtttctgttggatgtggctgtttggacggtgattcattgctacataactatgaaaatcaaacgaaaacataaagtagaataattaactgtacagaaaaaaaatcagatatgaaatttcatttaattaaattatgtttcttgtgtgtcttattggtgtcctgcaatacctccaaagaaattgtctattttcaagatatcgtagttaatcaacccgaggcgattatcggggcacgggatattaccgtacaacccaaagaccagatttccattatggtgtccagtaaggatccgcaattggcggctctgtttaatttgacacgggtgcaataccgtgccggatcttctgatttacgttctggcaacatcaatggagaaatatcaggttacacattggatgataaggggaacattgattttcctgttgtcggaacattgcatattgccggtatgaccaagagccagattgccaccctggtaaaaaaaaggctgatggaagagaatctggtaaacgatccggtagttacagttgagtttatgaacctttatttctccgtgttgggcgaggtgaaaactccaggtaaatatgccattacaaaagatcagattacccttttggaagccatcagtatggcgggtgacctaagcatctacggaaagcgagatgcgatatttgtcatccgtgaagaaaacggcgagcgtgtaacccattgggtggatatccgctcgaaagatctgtttaattcaccggtgtattatctgaaacagaatgatgtggtgtatgtacagcccaacaaggtacgtgccggacaaagcaccattaatgagaacagtgtaaaatcggtatcgttgtggatcagtatcggttcgctcctatcctcgctgggtgttttgctgttcaagtaatgtattgaattttattttataagatattaaagagagccaaaatgataaagaatagaacgaacacaggcaaacctaccgatgattttatacggatacaagatttatggggtatgtttatcccgaaatggtattggtttgccacttccttgttcgttgcgttggcaacggcatcattatatttgttgagtactcctaatgtctatacccggacggctgccgttttaattaaggatgactccaagaacaattctccggcaagtgcaatgaatgagtttgcagatatgggtatttttaaatcaaacaccaatatcaacaacgaactgctcaccttgaaatcccctacgctgatgacagaggtggtgaagcgtttggggctaaatgagatatatactattcgtaggggcttaaaaagaatagaattatataaatcaagcccgatattggtgacttatctttttgataataaaaaaagtgtaagttttgatatagaagttggtgcacaaaacaagttttatctttcaaactttatcgttgctggagaagaaactggggaacggtttgaaggaattataggagattccattcaaacatcagcaggaacattggccatcagcttaacttctcaatatgagaatttttttacaggcagcactattcaatatagtaaagaaccggctgatatggtggcagacagctatacgcaaaaattgtgggctgaattaggcaatgaagatgccaccattattaatttgagcattgatgatgcttctgtgcaaaaggcagaagatattttgaatacactgattgaggtttataacgagaaatggatccaggacaagaaccagatagcagtaagtacctcacggtttatcggtgaacgtttgggcgtgattgaaaacgaattgggtcatgtggatgagaatatctccaactacaagagtgaacatctgttgccggacgtacaagccgcttccagtctgtatatgagccagtctgctgagaataaaaaagaaattcagacactcaccaaccagcttgcgacggctcaatttattcgccgcgaattgggggggaaagagatgaaccagcctttgccaaccaactccggtatagccaacgtaaatatcgaaagtcaaatcggagaatacaacaagatggtgttggatcgcaaccggctgatagccaacagtagcgagaaaaacccgttggtgaaagatttagggaactcaatgcagagtatgaaacgtacgattcttcaatcggttgataatctgatcgtatcgttaaatactcagatacgcagtattcgccaacaggaagcaacaacaactcaacagttggcttctaatccgagtcaggccaaatacttgttatcggtagaacgtcaacaaaaagtaaaggaagagttatacctatatttgctccagaagcgtgaagagaatgaactgtcacaagcgtttaccgcttataatacgcgaatgattacagctccacgtggcagtgctttaccaacggcaccaaataagaaaaacattttattggtggctcttgctctcgggcttttagtaccggcagttattatctttatgcaagaaaacatgaacaccaaggttcggggtaagaaagatttggagaatttgagtgtgccctatttgggtgaaataccgttatatttccgaaacaaaaaaaagaagaataaattttcggaatatgcaattgtggtggaagagggtaaccggaatattatcaacgaagcttttcgtgtgcttcgctccaacgtggactttatgaaaagcaagaataccgagcagaaagtatttatagaaacctcttttaatccgggtagtggaaaaagttttctgtccatgaacatcgccatgagttttgccattaagggaaaaaaagtattggtgatagacggggacttgcgacatggaacggtttcggcttatgtagggtcgcctaagaaaggtttaagtgactacttgggaaacaaggaagtcgtttggaacgagttgcttgtgatagacaaaaagtatcctaatctgcatataattccagtaggaaccattcctcctaatccgacggaattgttggaggatggaagtctggcaaccttgatgcaagacttacgcgatgagtatgactatatctttattgattgcccgccgattgatattgtggcagatacacaaataatcgagcaatatgccgaccggacactctttgtggtacgggcgggattattggaccgctcactgttacctgaattggaaagtatttatcaagaaaagcggttcaaaaacctttcggtgatattgaatggtacggaaagtacaggtggacgctatggttaccgctatggttaccacaatgggtatgactcttattacggcaacacaaaatagaggggtattccaaaataaacaaggaaactgtttgctattattcccaacagtcaacagaaatgtgttttttccgacagaaaaaagtattagcggaaagcggttttttccgtggtttcactgattgccacagccatcttcttcccggggtagatgatggggtgaaaacgttggaagagtcgttggcgatattggaagaaatggaacgtttaggcgttcgtaaggtttggcttaccccccatataatggaagacatacccaatgaaacagtggatctgcaacagaagttccaagaattaaagcaaatgtatcatggaaagatcgaattggctttggcagcggaatatatgatggataacctttttgaggaacggttggaaaaggatgacttgttaccctttgaggaaggaaaacattatctgttagtggaaacctcttatttcaatccaccaatgggattactgtctattttgcaacgcatccaaaagaaaggttatcatcctttgttggcccatccggaacgatatgagtatatgcaaatgatggattataaaacgttaaaaaagaaccaaatttcttttcaattaaatataccgtcattagtcggaatgtatggtaagcacatagagaagaaagcgaagatattattaaaagcaggaatgtatgatttaggaggaaatgatgttcactcccttattttttatgtgacaacttgtaagcaaaaaatagacaatctgtctttcttgaaaaatgtgtgtaaaatatagcgtatttacattcgggaagactttgccctaatatgtgtttttttatgtaaatgaatgatttaatatttaatacaaagataaatgaaagcatgtttcatgggcttgggttacatcggactacctacagccattattgccgcaaagcacggcattcaaataacaggagttgacattaatcctcatgtagtgaaaatgaccaatgcgggacatttgcacatcattgaacccggcatggaggaaatgttacaggaagtagtgaaagctggcatgttgaaggcttcggttacaccggaagtcagcgatgcatacttcatggtggtcccaaccccgttcaagggaaaccacgagccggatgtgagttacgtggaagcggctacacgtgccgtattgccgttactgaaagaaggggatctttatgtaatagaatccacttcacctgtaggaactacagaggctatggcacgcatcatttttggtgaacgtccggaattggaaagtaagattttcatagcctattgcccggagcgtgtattgccaggtaatgtgatctatgaattggtacacaacgatcgggtcatcggtggtttgaatcctgaatctaccgaaaaggcaatagcattctattcgcaatttgtgcagggcacacttcacaagactaactgccgtacagcggaaatgtgtaagctgacggagaactccagtcgcgatgtacagatagcttttgccaatgaactttcgcttatctgcgacaaggctggtatcaatgtttgggaacttattaaccttgccaacaagcatccgcgtgtaaatatcctgcaacccggttgcggtgtaggaggtcattgtattgcggtagatccatactttatcactgctgatttcccggcagaaagcaagttaatcagcgatgcacgtgatattaacaactacaagagtttctggtgtgctgaaaaggtgaagaacgccatgttgaagtttgagttgaagaatcatcgtaaaccagttatagccatgatgggattggcattcaaaccaaatattgacgatttgcgtgaaagtccggcgaagtatattaccacgaaagtgatgcagagctgcaacaatgccgacattttggtcgtagaaccgaatgtaaaagagcacaacgtgtttaagctgactaactactgcgaagcctacgacaaggcagacatcgtggtgttccttacggctcacaacgagtttaaagagctatcttggaggaaggataaaatgatattggacttttgtggaatattcaagaaataatggatatttctaaataagtgcaaatacaattatcaccgaaactaatgaaaattgcacataaaatagttcaagtaccggaaatgaaatttttattaagaccttttatacacaatgtaaaaaggaataatcaaaatatacatgagattttccaggaaaaatctcatgtatattttcggagtttgataagattttgccacaaaacaatatcttttgcagcgtatttaccaatatattattgggggcggttcgtaaaaaaatatcaaaagcgtttcgatataataatcaccagtgcctgatacaagaattatgcatccaaattaaaatatatactcgaaaaaataggaatttatgtttatccgaagatttgaagtgttagctggaaataagacttgtgaagaaacatacaggaaacgtcatatcgacatagaatatatcttacatatatgaagactatccatcatgtctgtgtgattttggttacgttgacggtacggtatcgcatttagaattgatgaaaaaaattcggttgggcaaaattggaagaatcgaattccctatcagtcacgaaataacacattttttcgaaaacatagaatcaacgtattggctaatacaaatgaatggatcttgcaagatatgaactactatataacttcctattcagactttcacgacgatgacacaaagccaaggatgtttgaatagaaagagggtaaggcgatattaatgcatagtgagtatgaggagaagtggaatattattcctgtataaaattcttttagataatcctattattaggtgattttaggtttcaagatatgaaagggttgagttttattaagtcatcttcaggcagaactcaaaaggcacaaaagaatattttggggatgttgctcataaaaatttgcaacatcattattaatttggcttatgttccattgttgattaatagtttgaatcaagatagatatggaatatggttgacaattactacaattgtttcttggattgcattttttgacattgggttaggtaatggtctgagaaataaattggcggaatcaattgcttgtaaagatgaaataaatgctcgaaaatatgtgagtactacttatggtgcaatgggaatcttatgtttcttgttctttatcatagaggcctgcattgttccattttgcaattggaatagtctgctaaacgctcattcgattcctaatggtgaacttacattattaatgttatgggttctttcaagtttagcatttcaaatgctactaaaacttctaaattctgtattgtacgctttacaaaagccggcattatcctcattgatattgatgcttagtcaattgttcgctttcattggaatttttatttatacaaatgtttgcaatgaagtttctcttttgaaattgggaatgattatatcaatggctccagtcgttgtattgatgattttttcattgatactgtttagaaaaatgataccccaatatatgccaaccccctctttctttgagcgttctaaaataaaagagattgttattcttgggagtaaattcttttggattcaattgacgactttattattatttcagtcaaacaacttgataatcgcccatacttgtggaaatacttctgtggctgagtataatattgcctacaaatacattggtttgatagagatggcctttatgattatcatgactcctttttggtctgctgccactgatgcttatgcgagaaaggattatcaatggattaaaggaatattaaaaaaactacaattcatttcatatataatgattgccgctggaggagttttgattttattatcagattttgtatacaaatggtggttatcatcaactatcaaacccgataaatcattaatgtttcttctattattgtatttctgcatccaattatcatgggctagatatgggagcataatcaatggtattgggtgtgtaaagctccaattctatattacaatgatagaggcttttgtgcatattccattggctttattgcttggtacttattggggtgtaaaaggagtaattatttcacttattatatcaacatttgccaatactatttggcctaagatacagatcaaaaatatttttttaggaaaacgaagtatatgggtaaagtaaattctattacaaagctagaaatagcgatatttgtttttctcactatgatgatatcaggagcatcgtccattgctagtaatgattttattagaattatagttgtgggattattagctctttatagctttataaatcataagaatttatataataatattcttttttatttattaagtggatggattttaataaacctaatatcctcattatattttggtaaaaatatagatttttttccttttatagggaaaattgttttgatctatcttgcatatttatgtttatcttgttgcaaggataacttttgggataaatatgagcaatttttgtataaactggcgttaatttctacaatattttatatcttatccttgttctttcccagtatgtttaatagccttacttctgtattccgtccttttaccgctgatattttttatcagaaggagtctcagaaatactatttctatgctttcttttttacatatatgggtaatggaaacttcaggaatagtggttttatgtgggaaccgggtgcatatgcgatgattttaaatatcttgattgcatataatatatgtcgacaaggttttcaattgaatagacacattaaggtatatactataatccttttaactacattttccacagcaggatatttggcattttttatcattttgctactgtttcttttgaaaggacaaaatatttatataaaagcacttattcttatctgtactgctttttcaataggttggttgatgaatgcagacttccttcttccaaaaatcgaagaatttatatcctccgcacaaaagggaatagtacaccatcaaggttacaggaaactatatgaagccaatagaatcctttctttcaaattgttgacggataaatttttgatgtttccaataggttggggttgcgtccaagatacaacttcatatatggctttgaaacatattgttactgttaatggcttgggaaacacattagtgacatggggtattttcgcattctctttttttatgtactcgattggtaattttttctatcaatataggcagtcaattattattgttacactttcattattagtagtatgtattagtttttttagtaatcctatagaaaataacatactactctatttgttaattttatctccttatatcgtagaatttaattgataaaacatgaatattggcattatttgtaaataccctattccgtatggaatggcagccacaacacgtatcttctcatattctaagggcttattagaatgtggtgataaagttgatgtatggtcaattgcacctaataattttaacgcgaataataataatgaaggcgtttttaatggtatatcatatttttattcattcagaagcaaacgatttagtaataagctattccatgcatatgaaatgatttattctctttttatcttaggtgtaaaattacataaaagagataaaattagaagatatgacgtgtttattataagctcagatagtctcatttgcctgctgtatatgagggtattaaatatattatttaagagaaaacttatttttatttttgatgagtatccaacacctattagaggtaaattaaagaataaaataccattttggaaagaagtgatttatcgtgttattttaagtaaatattcaggatatatttccatgaccgaaaatttattgaaatattataaaaaaatcacagacaatccaggtattataatttcatccattaccgatgtcaatcgattccataatataataaaaaagcctataaataaaactaagaaattaatttatatgggaaatatggaattatcaaaagataatgtagacaatattttgtacgctttatctatcttgctaagagataattatgatgttcatttgtatctttttggaaaaccaaatttaaaagataaatctatattggaaaggattattgagcaagagggattagcaaacaacacaagttttagatttgctcaatataatgatgttccaaagattctatcagaagcagacattttagtttcctcccaacctgtgactgttcgtgcagacggaggattcccaactaaattgggagaatatttaatgtcgggtactcctgtattatcaaccaatgttggagaaacatcaaaatactttaaggatggcgaacatatgtattttgcaaaaccagaatcgccattggattatgctaacaagctcaaatatatcatagataattatgagaaagcattagctgttgctaaaaaagggaaaatgctaatagagcaatcgtattctcatatatctgctggagaaaagatgcataaatttttaaaatcattataaatagtatgtcagtattcaaagacaaagtcctgttaattacaggcggtacgggttcctttgggaatgctgtgctacgtcgttttcttgacagcgacatcaaggaaatcagaattttcagtcgtgatgagaagaagcaggacgatatgcgtcaccgcttgcagaattctaaggtgaagttctatatcggtaatgtccgcaacaagacttctgtagatattgctatgcgtggtgttgactacgtttttgccgccgccgctctcaagcaggtgccgagttgtgagtttttccctatggaggctactcgcactaatgttctcggtactggaaacgttcttctttctgctatcgagcatggggtaaaaaatgttgtggtcctttctactgataaggcagcttatcctatcaatgctatgggtatcagcaaagcacttatggagaaggttgcgattgctaagggtcgtgaacttggcgagggtgcggctactaccatttgttgtactcgttatggtaacgttatggcaagccgcggttctgttatccctttgtgggttgagcagatgatagagggtaatcctattactatcactgatccgaatatgacccgctttatgatgactcttgatgatgctgttgacttggttatatacgcgtttacccatggtcataatggtgatctttttgtccaaaaggctcctgccgctactttggagactcttgctaccgcactgaaggaaatatattctaaggttgatccgaaatatggagatactgaggttcgcgttattggtactcgccacggtgagaaactttatgagactcttgtcactcgcgaggagatggctaaggctattgatatgggcaattattaccgtattccttgtgataaccgtgacttaaattatgacaagttcttctctgagggtgatgaggtggtttctcgtattgaggattatcatagccacaatactcagcgccttgatgttgagggtatgaagaagcagttgatgcgtctgcgctttattcaggaggatttgggcttgattgagaaggcaaaggcgcgcgaaatccgttccgaatagccggtgtgtgaaaaccggcaatctactgcgttgccatcgacttcgcaaagtattttttttggggggggaacaattattcaaagtgttcccgctattgagaaatcaccaataggaaatcttttacacacaggaagacattatctttcttttccatcataattaaattttatctcaatgaaaatattagttaccggagccaagggctttgtcggtcgaaatcttgtttcgcaactttacaatatccgcgacggcaaagctcgcaattacggcattgacagtgaggacttggccgtttatgaatatgatattgacagtgaccctgccgaccttgaggaatattgcaagaatgcagactttgttttcaatcttgccggtgttaaccgcccgaaggacaattctgagtttctgaagggcaatttcggctttgcgtcggtgcttcttgacactttgaagaagtatggaaacacttgccctgttatggtttcatcatctattcaggcggttcttgacaatccttacggtgagtcgaagcgtgctggcgagcagttgatgtttgaatattcggcggaaactggagcgaaagtgcttgtctaccgcttcccgaacgttttcggaaagtggtgtcgtccaaactataatagtgccattgcaactttctgcaacaatatagcgaatgatcttcctattagcgtcaatgacccgagcattgttatgaatcttgtttatatagacgacgttgttgatgagatgatagcggcacttaacggcaacgagcattgcaatgaaaacttctgtgaagttccagtcactcatacccgcacacttggcgagattgttgagattatccgctcgtttaaggatatgccagcaaatctcggcgttgcagatatgggcgacggtttggctaagaaactctattcaacataccttacttatctgccgaaggagcgttttgcgtatcctttgaaaatgaacgtcgacgagcgcggcagttttactgaatttatcaggacagccgatcgtggtcaggttgcggtgaatatatccaaaccgggtattaccaaaggtgagcactggcaccatacaaaggtggagaaattcgttgtagtcagcggtcacggccttattcagatgcgtaaggtcgattcagacgaggtcgtcaattttgaggtttccggcgataaaatcgaggttgttgagactatcccgggatacactcataacattgtaaacctttcagaaacagagaatcttgtaactctgatttggtgtaacgagtgctttgacccgaaccgcccagatacttatttcgataaagtagtaaaatagcaggttatgttggttatcgacaaagaattgcttgacggggtaacggcacaggcaaaggcgagtccccgtttgcggatgaactacaatctgcatgacagtcttgaggcaaaggcgcagagactgatgaacgctatggaacccggaaccgatttgccgattcaccgccatacccatactgcagaaacgtatttcgttctacgcggtagaatcaacgtgctgttttacggtgaagatggtcagttggaagaaagccgtgaacttgaccccttgaaaggatgttacggcgttcagattcctatcggtcaatggcatacgattgaggtccttgaaagcggaacggtaatctttgaagttaaggatggaccgtacacaccacttactcctaaaaatacaatgacaaaataaaatattatggaattaaaaactgactattcagatataaaatttgcggaaaacggcaagttgaaacttttgataattgtaggaacaagacctgaaattatccgccttgcagccgttatcagtaagtgccgcatctatttcgacacaatccttgctcatacaggccagaactatgactataacttgaacggcatctttttcaaagacctgaagttgaaagaaccagaagtgtatatggatgccgttggcgatgacctcggttcaacaatgggaaatatcataagtgcttcctataaactcatgtcgcaggtaaagcccgatgctgtacttgttcttggcgatacaaactcatgcctgtcagttatcggagcaaagcgtctgcacatacctatcttccacatggaagcaggtaatagatgcaaggatgagaaccttccggaagagacaaaccgccgtatcgtcgatatcatcagtgacgtcaaccttgcctatagcgagcatgctcgccgctatcttgcagaatgcggattgccgaaggagaggacatacgttaccggttcaccaatggcggaagtccttcataataatcttgaagagattgaggcaagcgacattcataaccgtctcggccttgaaaagggcaaatatatccttcttagcgcccaccgtgaggagaatatcgactcagaaaagaacttcacttcattgttccgggcaatcaatgcgatggcagagaagtacgatatgccggtgctttatagttgccacccaagaagccgcaaacgccttgccgcaaacggattccaattagacaaaagagtaattcagcacgagcctctcggatttcatgattataactgtctccagatgaacgcatttgccgttgtcagcgacagtggaacattgccagaggagagttcattcttcacatcagtaggccattcgttcccggcaatctgcatccgcacgagcacagagcgtccggaagccctcgacaaggcatgcttcatattggcaggcattgacgaaaaatcattgcttcaggcggttgatacagccgtagagatgaacaagaatcaagataacggcattccagtgccaaactatgttgatgagaacgtatcaacaaagaccgttaaactcatccaaagttacaccggcgttgtcaataaaatgatatggagaaaataattaagaattttacctaaatcatcaataaataatgaaagttctttattctcatcatggcatgaaaggaaaaaatggatggggacgaaccttttatatggcacaaggattagcagatttaggacatgatgtgaccttattaacaatcaatcctaaatgttcattctttaagataaatactattatctatcaaggtgttaaaataaaagtactaccagacttttttcctgccaaaatgaaatcctcaggttttgctatttggagtactttatttggattgatatactcgatgttccataaatttgaaatatgtatagcagattgtggacatagatttacttccttaccttgtaaattaaatagatttatttatcattctgtttatatttctgagtggtgggatttctttggtaaaggaggttatattaaaaagaaaagtagattgtttaggttaacatacggtagactggaatgctataatgaactcaacgataaaagaaaagctgatgctatagtcgtattatctacttttatgaaagatagggctgttgaaaatggaattgactcagaaaaaatttttattgttcctggtgggtctatagtgaaagatgtaaagccgttatatccatcctattcatctgttgaaaaacgaaaaataaatatagcatacattggcattaataatcacgaaattgatttgatagctccgtttatagaagcattgaaatgtgaaaatgttaaaaacagttacaggttgattctatatgggaatactatctcaaacgaaaagtggaatcaattaggattgtctgaaattgctgaatatagaggatggttagattattctaaagatgtttctaccttaaaagatatagatgtgtttttgcaattattagatgacaacaatgtttctaaagctggatggcctaataaattaggtgattatttagcatttgggaagcccgttatattgtcaccttatggtgatataattgattttgtaaaaaatgaaaaaggtttttttatagtagaatacaataaatactcgatattaaaaattttacaagaaattaaagatataccttatagcgatttaaagaccatggggtacgctaataggcaattagcggaaaaaatctcatggaaaaatagagcaaaaaatatagaatatatatgcaataaaattagatttaataatgaaactgtcaagaattaaaaaacttgtcttccttcatttgcagcatttgccaatgaagtcaagggggtggagaccaacgctttgtaaatggggggggggtaaacatcaaatgccctaaaaagaccttcatcggagaggacgttattttcgacacaaattatcccgaagatattgtcattgaagagggcgtgcgcctgactgtcggcgtccggattgtaacgcatttcatgaacccgaagacaggcagttatgaccgcggtcaagtgcatgttggcaaaggagcctacattggcatgggaacaatggttgtcaagccggtcacaatcggagaaggggcaatcgtaggcgccggggcaatagtgacgaaagatataccgtcaaacgaagtatgggcaggaaaccccgcccgctttatcagaaaacgataaaattatgccaaacgcaatatttttttacagaatacagaggtggttatacttacaccacattccatttttacctaaattaattcaactattaatttttctgatttacaacactaaaattactgctgattcaaaaatcggtaaaggatcttattttgtttgtaaaggaattagcactgtactaatcccaggaacggaaattggagaaaactgcgtattaggtttacgattctcaacagtaagaaaatttccatataaaaacgttcctaaaattggcaataacgtttttatcggtccaaacgttgtaatctgtggaccagtagaaattggtgataactgtattgttgcagctaattcgtttgttgataaatcattaaggggggggtaattgttgcaggctctcctgctaaaataatcggatatactaaagacttaaactataatatttcttcaaatcaaaaagatttagatggaatagcaccatatctgcaaccaaaagagtaaatcaaaagttgcaatcggatatagttttaaaaggataaaactatgttgaatgcaatctctttttatcgggtatcaaggtggctgtacttgcaccacattcctgtactgccaaaattgataacattgcttattttcctaatttacaacagcaagattccataccaggcaaagattggcagagggtcaacttttggatacggaggtatgggtgttgttatccattctaaatcaattataggggtaaactgcactatatgtcagcaagtttccataggggggtaattcaagatttccggaagtaccagtgataggtaataatgtttatattgcgaaaggttctatcgttatgggtggtataacaatcggaaacaatgttacaataggagcaaacgcagtcgtaaccaaaccaattcccgataatgctatcgttgcaggcgtacccaccaaaattctaaggactaaagaataacataatatgcataaagttatcaactcttttcgcttgctgaaggagtattgcgagaatgaggggttcaagggttgggatccctatgacggacttaactcgaaggtttttcaggcgttgccgttcctgaagaagtcggcaatctgccgcctggttgttatccaaggatttaagcgctgcccagtcaatctccgcaggcttgcgcttgtccccaaggaatataatgccaagggcatcgggcttttcctttccggttactgcaacctatataatgcggttaaggcaaaccccaaacttgcggaaagcctcggctctcccgattccctgaaatcacggattaacgaactggctgaactgttgatctctctacaatcaaaaggttacagcggtgcttgctggggatataactttgactggcaggctcgcagacttttccttttcccaaagtttactccaaccgttgttgcgagcaatttctgtgcaaccgctcttatggaagcatacgaaattaccagagagaaaaggtttcttgaaatcgctctcagtgcggcacatttcgttatcaacgaccttcaccgcacggaatataaggacggattcctattctcttacagcccgttgcagggaaacgacactgtctttaacgcctcactgctcggctcaaggctgcttagtttttgctacaagtacacaggcaacgaggaatactgcgaacttgcagagcaaagcataaaggcatgctgctcaggtcaaaagccaaacggtgcatgggtatatggcatgctacccgttcagagttgggttgacagttttcatacaggctataaccttgatgcgcttattgcatatcaggagctgacaggcgacaataagtatcgcaaatatattgagaagggctttgaatattatattcaaaacttctttgaagccaacggaatgccaaaatactacgacaaccgcacttatcccatcgacattcactgcccggggcagttgctcgtaacgctcgcaaggttgcacaagatcgaagaatacaaggaaattgcagaaaaggtcattgattggactatccgcaatatgcaagaccggaaaggctatttctactaccagttaaagccggggataagttcaaaaatatcatatatgcgttggagcaatgcgtttatatttaatgctatgagccattatttacttgccgaataatattttaatcttatggataaagtttcattaaacggggtcgaaatattccctttcgactccgaacagcaactattgcattatgtggacacgcataagggcatattggtagcgatcaatgcagaaaagatattgcatgccacggaacagacacgtgccattatcaatcgaaatattgggtattgtgatggagccggtgcacaaatggctttaaagcagaaaggttataaagatgcctgtaagattcccggatgtgaactatggctaaagattattactcgcttttacaaggaaaagacattctatctggttggtggaaaaccgcaaatcgtaaatgagaccgtagagaaactgtgttctgaatatcaggatatccgaatagtgggttatcgtaacggctatatcaagacggatgaagagaaacgacgattgatagacgatattgtggagaagaaaccggatgtggtattcgtggctatggggtcgccaaagcaggaattgctgatggaggagatacagcaacggcatcgcgctatcttccaaggattgggtggcagtttcgatgtctatacaggtcatgtgcagcgcgcaccgaaatggtgggtggagcataatctggaatttgcttatcgcttgataaaagaacccaaaagaattaaacgtcagatccacttggtgaagtatgcttggtggctgatgaagaaaaaattataaacagaggaaatatgaagaaagtgatgttggtcttcggcacccgtccggaggcaatcaagatggctccgctggtgaaagaattccagaaacagccaaaacgggtagagactgtggtgtgcgtaaccggacagcatcgggaaatgctggatcaggtgttgaagatattcgacatcaaaccggattatgatttgaatatcatgaagcagggacaggatctgtatgatgtgaccgctcgtgtgctgaccggtatgcgtgatgtactgaaagaggtaaagcccgatgtggtattggtacatggggatactaccacttctacagctgcagctttggctgctttttatcaacagataccggtgggacatgtggaagctggtttgcgtacacataatatttatagcccatggccggaggagatgaatcggttgttgacggggcgtctggcgacctatcatttttctcccactccgttaagtcgtaataatctgattaaagagagcgttgatgaccgcaatatcattataactggtaacacagtgattgatgcactttattgggtagtggataaaatcaagaacaacaaggagctagataatgaattggaagatatattgagcaaagcgggttatgatgtaaaccgcttgaacaatggcaagaagctggtattgattacagggcatcgtcgtgagaattttggtgacggatttatcaatatgtgtacagctattaaagatttgacggttaaatatccagatttggattttgtttatcctatgcacttgaatcctaatgtacgcaagccgattcatgaggtgttcggggagaatctgtccggcttaaaaaatatgttcttcattgaaccattggagtatttgagttttgtgtatctaatggagaagagcagcatcgtattgacagatagcggtggcattcaagaggaagctccgggactgggtaaaccggtattggtgatgcgtgataccacggagcgaccagaagcattagatgccggaacggtgaaactggtaggtacggactataataagattgtaaacgaagtatcatctttgattgatgataaagcagcttatgaaaaaatgagtaaggctgtaaatccgtacggtgacggattagcctgcggacgtattgtaaatgcattgttatataggatataagctgagctatgaagctgatactgaaaaatatttttacaaatcgaaatacttgttattacttatggtttgcattaccaagagctaataaacttaaagtgaaagttttttctggagttgaacttcattatcgggacttgtttcatggtaagatatacgaattgttgcaaaacctaacatcgggtataaaatgaagaatgataaacgaaaaaaagaaatttttcggtggatattcctcggaggacttttgttgtttgtgacttttcctgtttttacgcagtaaatacaagaatgagtggattgatttatgtgccgagcacggacatagatgatggaggaaaaactcgcataggtggtcactttttcagaaaagagttcctgcccgatgtcagcttgaattcgttaggaaagtggatgtatcatacaggcaatcattttttgagcatcattcctttttcatagattgagctggaattatttgtactatacagaaaaaattaaaagacagcaatatagataatatggattttgatcacaagaattgatatttatctaaaagaatcaggcctatcaaagaaaacgaatgatgatcatgtattgctattggaagtaatgatcacattacgacgagtgacaaggtgaaaagagatgattggccggatagtagaagaaccatattggggaactattatgttgctgccactaaatatacgaaaaaaaaacatatcataggtttctatgtcacctaccgaaaatgaaaacgtgattacaattaaatggaatggagtggcagactgtatgacttatcagtcctctttgcaaaacgggaaatattcttcggaaggtatatgcttttacatcaacctactgtaaaatactaatcaagaaaataataaggatgcctacagtcgttgtccgttttgagacttgtaagaaagccatagggtacggtacggtttattaccgtatctacaaaggacataaccgacgtatggaattttcttcccaccttcacctaccaacttcttcttgggatgaaaccacaaagacaatccggggagagcatcccaaagcctgtctctttcgtgctcagatggaagcggatcttcggcttttgaaccggattataacggaagatgttaccggtcgactgacaatgggcgatatgatagccatctttaaacatcaaaggacaataatcaaatgaacttttgacttgtaagtcaataggatggtaccgtctttgacagattgctatcaccgtctaggttttcaggtaacagaatccgaagatggattacggataggcttcaaaccgggaatggcacatgctatcgtgaaggagatttggaacgagcagcctttgacccgttcggatgttgaaaggttttatgaaaagctttcttcactgaacaaaggatatcgaaatctctatttcaggatcgtggcgcacggtggattcctgccggaagcattggactttgaactgcacgggctgaccgtttcggatgaaagctatattgaaagcctcttgtccggaagacatgtggagctttatccgcataacgaagcggcttacagggcgatcatgcggggattcaaacaacaccgtatcggtacggtcgtgcaggctaccggaacagggaaatcctatttgctggcacgctatatcgcagatcatgcaaaggaaaatatattggtctttgctccgaacatcacgattctggatgagatccggaaagccgtcggattctccattccgcaagtgacgtaccggacattccagtcactgattcgtaaccgggaggacaatgggttgttacgggcagatcatattcttattgatgaattccatcatttcggggcggaaatttggggaagtgccttgcaggaagtgatagaaaacaatccctgtgcctatgtcctgggaacatcggcaacgccaatccgtccggaaggaatgatcgatacggtggatctttatttcgaaggaaatttgttttatgaacttaccttgccgcaagcttggtattacaatatcttaccagtgccgatcctggtacaaagtgcttacgggctggacaacgaactggatcggctgcaaagaaagctggaacgcagcggttgttcagtccgccggagagagcgcatccaaaagaaactggacctggcgcgggtcgatttcaaaggtgctttgggcgcgtcgtcggtgatccggaagttcctacccgaaagcgtacgcaaactgctggttttctgtcgcgacctggccgatctcagacagatggtgccggaagtgtgcgactggctcacacaggcaggccgatcgattacgccatttgaaatccatcatgcgcaaagcgagcaggagaatcagcggctgttggccgctttccgagaagagtcggaccggttacacgtactcttttccgtcaatatgctgatcgaaggattgcatgtcgagggagtggatgccgtcttgttcctgcggcgcaccgaatcttacattgtcaccctgcaacagctggggcgctgtctggatgccggaagcgggaaacagccggtcgtcttggatttcgtgaataacctgtcgggtaaatcggtctacgacgtgatggcgtgccactgggagcgactctcttatcttccatcgccccacggatttgaaagaacaacctcgttcctcgctaccggctatttgtcggatatccggctccgcatcgaagagatcctggccgagctggaaccatggcagattatgtacgagcggctggtcgagttccaccgggaagagaacgactggccttcagtgacggaagggaaactgggcctttggtgcaacacgcaacgcatcgcctacaaacgaggctgtcttgccaaggaacggtgcgaccagcttgatgcaatcggttttgagtggaatcagctcgactccaaatggatgagggaataccatgcattgaaagtcttttttgatacctgcggacgctggcccaaacgtgaagacggcccgcttgcgacctggtgttatacccagcgggaaagacggaaggatggacgtttgagcaaagagcgcatccgggctttgaatgagatcggctttgtctggaatcagaacctccaaggggaatggatgaagaactacgaggagctgaagtcttttgtcagaaaatatcggcgtttccctaaatcgacggaagggaatttgggcggatggtgccatacacaacggaaaatgcgtaaacagggaaagttacccaatgaccgccggctcctgttggataaaataggatttgtctggtcggcggaacaggtctggcaaggcaacttcgaacaattgtgcctgttccataacctgcaaggacgatggccgggatgccgtgaaggagcattgggacgctggtgtaccattcaaagacgggattaccgcaaggggaacatgtcagacgagcgaaaagcacaattggaaagaatcggtttccctcttgcctgatatggaatatattcgattctatccgttatgaaagttgtctattcaattataatcaacattggaacagtgtctgtcattacccggatttggaactgccagcatacgggtggaaccaactgataaaaccggaataagaccaatctcataaagtaaatcgttattgattcatcccaatatggaagcccttgtctgaagccggttatcggagaagacaggggcttcttctatattttataaatgaattatagataactattacactggcttaacgaatccgttacaaatccttggtggtttaaagtgagtgtttacgtaaaatgaaaatatttatggtagcaaggaaagtttcattacagcataaggttcttttagggtatatgatattgatcatggctgtttgcggcatggtttccatcttgttatacgaacggagccgcatgcgtgagataaaaacggaaacatcggagatacgcaggatacgccatgacatcagtacggcgcatcgctatatcacggagcttgccacctatggagagtccgtcattgtctgggaggataccgattttcgtgagtatcgcagaaaacgcttgcaaacggacagcttgttacaaatattgaaagtgagttgtggcacgttcgtcctgccaaagcagatagactccctatgtcatttattggaagctaaggagatacatctgctccgcattatggagaccattaccagacagggggaagcggacagcctgctcgcaaatcgtctgcctattgttatcagggaagcggttcgtacccggacagtcacccaaaagaaaaaagggattgccggttggttcggagggaaaaggagcgtacaggtcttcgagccatcgaaaggactgcaagatttgaatgagaagctgatcgccatgcaagaggaacgtgaacgccggatagacatgtataccgacagtctgcgcatacagaataaggccttgaaccggaagttgcaaatactcatcacccatcttgacgggcaagcgcaggcggcgttcatcagtcgtgaggaaaaaatcacggaagccggagatttttctttcaaactgtttgtcttggtaatcgtctctgcttcctccttgctattcatctcgttcctgatcatacggcatgacatcaggaaagaaagggaagggcgggcacagctccaaaggataaaccgtgagaacgaggaactgctcggtatgcgtaaacagatcatcctgaccatctcgcacgatatacgaggaccattgggtaatatcaacaactgcgtggaactggcctcggaaacccgtgaaaagaaaaaacgggaaggctatctggagaacatccgccattcctgccgccatatactgaatctggtgaacaacctgatggatgtttataagatcaatgagaccaaggatacccgtaacgaggttcctttccgtctaaacaacttgcttgacaacatatcgaaggaatatgcccgcaaagcgggtggccgggccttgctgttcgagcaccggcataagaatgtcggtgatattacagtgagaggagacgcagacaaattggaacaaatattggacaatctgctgacaaacgccatcaagttcaccctgtcgggtacgatccgtttccataccgagtacatggcgggaagattatatgtggaggtcggtgataccggtatcggtatggacgaggagacattggaacgtgtcttccgtccgttcgagcgtgcggcgcaggagataaactcggaaggtttcggtcttgggctttttatcacgaaagctcttgtaaaggtactggacggaagcattgaagtagagagccgaccaggtaaaggtacaacattccgcctgtcgtttcccctttcggaaacgacaggagaaccggaaacagaggagcttccggtacaatctgcgacaatacttcccaaacatgtactggtagtggatgatgacagcatccttctgaaaataacggaagacatgctcgggcgcaacggggtggaatgcacgacctgtcaaaatgcaaaagaagccattctagcactcgaccgcttggattatgatttggtattgacagatatacagatgcccgtgaccgatggtttcggcttgttgagattactgcgtaactcggatatcggaaattcccgtaccgttccggtcgctgtcatgacggcacggggggacggggactcgggcgtgtatatgaagtccggtttttgcggttgcatacataagcctttctcttcaaaaggactgctggcctttatctcctccgttacggagggcagaagtgcaggcatgtctccgttcgactattcccgcctgatggaaagtacggacgaccgtcgtcatatgttcggtcttgtcgcaaaagagtcagaaaaggatcttgccgaactggaggaggctttaagagaaaacgatcgggaagccatgcggaggatcgtacatcggatggctccggtctgggagttgttaggggccaacgatgtactgttcggttatcggaagctcctgcatgacaagacctcgagcgacgagacggtcagagagtacacgatgagaattatgaaacagatacggttactgatagacgaagtaaataatgaattaagaaagaaaaatgacggggatgaaaaagactttattgatcgtggaggacaacctgattctttgcgatattcttgagagatggctacagaaagccggttacagggtattgacggccatagatgagccttcggcacgccggaaaatcaaggggaataacgtggcgctggtactgacggatgtccgccttcccgaaggggatggcatcagtttactggaatggagcatctcccaagggttacatatcccttttgtggtgatgaccgaacatgcctccattgcagatgcggtgcgtgccgtcaaattgggcgcaaaggactacttgcccaagcctgtccacgaggagttactgatggaactgttacggggattgatcggtctgccagtttccgttcccccgaagaaatcattaatgaaaaggcttagcggggcggtccgggagaccgagcggatagcttgtcgtgtggctcctttgaattgttccgtcatgatccttggaccgaacggtagcggaaaagaatctgtcgcacagctgatccaacagcatagcgggcgtaaggacaagccttttgtggcggtgaactgtggttgtatccggggggaacttgccgcatctgagttcttcggtcacgtgcagggggcatttaccgatgcgaaaaaggatactgccggctattttgagacggccaagggcggtacgctcttccttgacgagatcggaaacatgcctcccgaaatgcagacactgctgctcagggtattacaggaaagagtgtattgtccagtgggcagccgcaaagaacttgaagccgatgtacggatattgtcggccaccaacgaggatatggagcgtgccatacgggagggacgtttccgggaggatctgtactaccgtctcgccgagtttgagatacgccagccctctctctccgaatgcccggaagatatattgccactggctgacttctttcgtgagcaacattcagaagagatacgtgtggagacctccggttttaccgaacaagccaaaatctccatgctttcccactcatggccgggcaatgtgcgtgaacttgacaaccggataagacgtgctgtcctgttggcggtatctccattgttaacccataaagatctgaatcttaatgcgaccatctgtaggacaggcgaaaaatgtaaaaaaggcttgatggaagaagcagaagagaaagaactaataaggaagattctggaagaatgtggaggtaagatcagtcgtgtggcgagaatgttggggatgagccgtccgacgctatacaagaaaatggaaaggtatgggttgagatagcatcttcatccgtttcgtttatacataagccggcagattccgttggagaaagttttgcagccaagaagtttccagcgggcagaccggaattctcccgtcaaggggattccaccaccataagaaagaggcagcagaaaaagtactgtctcatccaccagattataccgaaaaagtccatcggcatattccgcacttcctccatctcccactcctgccagataaatacaatccttgtcatgcttttcctttacattcagcaagtccatcaaaccgtaatgggggtagatgtggaatgtggcctgtcgctgccagcgtgggaaaccataccgtttgttttccctcacccatcgcataagcatctcgtcttcatgcggaaggaacccgtccaaagtgagtgccatgataacttgaatttttgccatacctcttgttaaaaaagcatgaaacccatgcttatttcgaacagaggctctgacaaagcccaacacagaaacccgcatgggctcatgctataaggtatagcataagcctcacgcaatagcctctgtgtttttgaatttgtcagattcctgttcgagacgtcttgcgacttatgtataataatggcggtcccaattgtcgagaccggccttatttctctatttcaagtttcaaatatacggcatctttttcaataatccgatcagtcggggtataatttcttcaattacccctccacttgtcatgatttgtcggggtcctttcctttttcatcttccagacctagtcgtttacggagttcagggtcatttttgatacgccgcatctcctcattgataatagcctgcgcatccgccttgatctggtcgtaattgcgttgtatctgttgcatcatgatgtcgttaccgttcctgtccttgaagtcgttgatgaccgggattttctgataagccttttcttctgcgctgatcttggtatggtccacgacaatttcggcatgaaatattttttgctctatcctctcatcaaaattatccgccacagccccgacaaacgtgccttgtgagaggttggcgatctttgatgcgggaatgagcgagtctagctgtgtgttgatggaggtggatacgtcctgacggttgatggatacggactgacgttgctgaagcaccttgccgaagcgctctgaaagcgtttttgcggtttcaccgaccacctgtccgctgaaaatattccccaccgtgttctggatgaccttggattctttttctccgtagtcacgtgtcaattgactgaaatcctgaaaacccagaagcacacccaccttgttgcttctcgccgtcgcgatcaggttgtcaagcccacggaaatagatggtgggaagctcgtcaatgataacggcgcatttaagctgttttttcttgttgataagcttgacgatacgggaattatataatccgagcgctgccgaataaatgttctgcctgtccggattgttgcccacgcagagcagtttgggctctttcggattgttgatatccaatgaaaaatcattaccggtcatcacccagtagagttgtggggagatcatgcgcgtaaggggtattttagccgaggctatctggccttggagctggtcctgggcatttcccttccatgcgtccatgaagggagaaagatagttttccagctccggataagaggtcagaatggtgaacaggtctgagtagggtttgttgagcagttctaccgcatggggaaacgtacagtaaataccgtttttgtaaatctttaaataccagattattgccgcaagcagaatgataggagactccacgaagaagtccccctgcttttcgatccaggtgcgattgaggttgagcattatcgtatagcttgcctcgtacgcatcggaaatgtccgtcatgaattccggattaatgggattgcaccggtgagacctgcgcggatcgtcgaaattgatgacatagaaccggggctttacctcgtacttgtccatattcttcaacaaagaattataggcgatggtggacaggtcatcaaacttgtaatcatagatgtaaatcgcaaagcctttggctataagctggcgtatgtaactgttgactatcgcataggatttgccgctgcccggtgtcccgataaccatgcaggcacggaaaatattgacaatattgacaaatccgttattccagcgttttttataatagaatctcgtcgggaggtttaccgaatattcattctccatcagtcgggtttcctgcatgaaactctcattttccatattgaacacatcttccatgaggttgtgcctgtaaaggcggctcatccataatcccgacatcaacagggcgagatagcctgccgtaagagtaaaaatatagaatgcggtatttgccatgtgtggcaatggcagtttaagaagccaccagttcagaaaaaacaatgcgcatcctgccaccaacaccgcataaattttaggccaggttattttttcacctttgaccccatgcgtacccaggcaggaaacggccaacagaagcactgccaacagtttgctccagagaatacagttgaaaattccggtcgtgttgttgaagtttaccagaatccggtctatcacctcaaggttcaggtgccatgcggtgatactcggatagcagtacacatagacgtgtaccaccaaaagaaaaatactcacggccctgccgaattccattatcttagcgagagccctcaaatcatcttcctgctgcataagaattgtatataaatgggttgatacttgttttgtctaaatgccacgcttgcgtccggtcttcttttttttcttcatgcggcgtgcaaaggcttcctcctcgtaatcccgcggattggtttccaaggaaaaaatgcctgccgccagttcgagcgtgctagaggattcgtgacggtgatgctgccaaagttctgtagcggaatgtccgccccgttccttttcgggtatgttttccaaccatttgaaatagtcgttgaacacattggcagaaaacaccttgcccatgcgtgagccgttgaacacctcccgatggttgtgatcaataaaggtgacaccatagatacgtccccgctcattcttgcggaaaaccacatcaatacgcctttgcccgagcagttccacaaaccgtttctgtgaatccgcctgccgcaaggcacgaacgatgtccgcctgtatggagggggcccatttcccatctttgagagctttcagatttatcagcatccgcttttccaactgttcatttccgaagcgtttcccaaatcgggaacttttgaacggtgggctgacaaccttgccggtatcatccgtgaccgaatatacaatactggtatatggggtaccgttgtattctcccctgacctgtttcgcctcgatgttgagcgtggaaagcagcgcattgtattccccgaaggtttggaaacggtagctttccaatacggctttaagggtattacctacctgatggcggacatctcccaaggaagcgtccacctttcttagttccgcttttggattccgcttttccgcatccgctccgtttcgcagaccgaaatccacttccagctcccgacaggcggtcatggaacgccgatgctcgtaggcatcgctgatctttttcccctgttcatccacacagacactgacaatatggatatgggtattgtgtgtatcggcatgtttgtaggtgatgtaaggctgattcccataccccatcttctgcatataacgttccgccagttctgccagccgcccgtcggtcagccggtcttccggtgctggggaaagggaaatgtgcaggacgggcttctccgtattgcggtttgccagcaggtaattctcaaaagagagcaatgccaagcgcatgtcctcgcttggcaatccgagccggtcggaaatcatacggttaccggaaagaatctcagccgttccggctgctaccttctcgtagttataagcaagcgctccgtaaagactcatgccatggcttatttttgcaaccatttccgctcgtattcctgggttagcgccatgacctttttgcagatgagcatcagctcaagactcaatctttccaacttatagagcaatgccatcgcccgtttctccccgaaattgttcttcaaggcacggacgacctggttgtagttgttgccgacagcctggaactgtttgtggaattctgtcagcctgatgtaatagtccatcgtcgccttgtctattttcacgacctttatctgtcccgagaagatggatttcttgatgaacagcgtgaggttgccggctcctgaatccgccagcaacttttcaaatcttgtgttctcctcggcgttcaggcggaaactgtacttgtggtccgccggatcatttttaggctttctgcccgtccttgtccctgttgttttctccatacacatgagatttttggtttgtacttttttctcttccagaatccgcgactttggagcggattcccccgcccctctgggcgggcaagttggttcttgtcggacaaaagactttttgtcggacaaggacacaacttgctctgttcgcttgaacagagaatcctccttcgtcggattgctgcgcgacgttcacggaacgctgtggtccgacgaagtcagttcttttccatcgtctgattccgattttgcaaaattagacagtgataaccgattggtaaacagcgtttgatatgacatttgatgacatctgacgacatttgatgtcaggtaggggaaatgttggtggaagtttcaaaaatagtcgctacttttggcacagtgcatgagggcatacattgaaacattgtcctgtaaggggtattgcttgcctgccacaggtggtgcatggtgtgaatgcggcatcatccatatatgtgcaatgccatatatgctgcacgacaatcctgcatgacggaatacattgcatccgtgcaatgcagtatgggatacattgaaccccatattgcatgaatgcaatgcaccttatatggcaatgcccatcggcaaccggtattacactggtgcaatatggtatgcaatgtattcatgcaaaccggcaaacaatgcgtcattgccatataccaacggatgcattgccgtgtgatgaaacaaaaaaatccggacagatatgaaacaaattatacactctaaattcaagcctatgaagagagatcctttatttgtcgctttgagcaaccagaaaggcggtgtgggaaaatccacgttcaccgtattgctcgccagttatttccattacctgaacggatataacgtacttgtggtggattgtgattatccacagcacagcatcagtgccatgcgggactgggaagtggggaacattgaaaagaacgtgcatctgcaaaacctgctggtggaacagttcggaacaagcggcaggaaagcctacagcatcctgaactccaccccggaggaagccagggagacggccggccgctttctcgaaaagtcggagctggactatgaccttgtcctttttgacctccccggaaccgtgaatgtgcccggtgtcttccaatccgtgatcaatatggactatgtattcactccgattacacaggaaaggatggtaatgcggagcagcatgtcttttgtccttgccatcagggaatacatgcaccggcatgcggacgtacccttgcgtggcatccatatgttctggaatcggatggacaaacgggtgtccaaaggcctgtataacggctatactgaaattttccgctctctgaaactaccggtgctggagaccgtcattcccagtgcggaacgctacaacaaagattccgggatgaaggggcctctgttccgcagcaccttgttccctccatcttcctccgcactgaaaggcagcaacctggacttgctagtatcggagatggaaaccatactgaaacttaaatagataatattatgactaccaagagaagaatggattaccgggtggacgaggatgccttgaagcgcatgatggcaggggatgtcacggcattggaggaaacagttccaccggctgaggctctgggaaaagaggccgtccctttccgggagacgcaagataaaaaggcttctgccagtccttctaaaaagcaaacgaggaaatttccggatgaagtaaccggtaccaatgaataccggctacgttttctggaagcaaagctggcgggtacaagaaggcagacctatgttaacgatacattatacaggactgttgccaaagtattgccggtcattgctccggatatgtccgtcccgatgtttttaaacagtgtcctgtcagaccatctggaaaggtatcaggacatcatcaacgagatatataaccaggaagctacacaaaaaccgatagaatggaagaaatagtttatttatcgatacggctcggctgtaccgcttatctattatataaggtatgggagcagaagaagagaataggtaagatatgtgacctgctttatactccccgtaagaaaccggaaatggagaaggaccaccacgggaatccggaaaatgcggcagatgtgatgggtgccactcgttttgtctatctggatgagaatgccggaaagaccgttgccccttacatgagccagcaattggaaatgggaagcgaccttatcggcaaggatgaggatattccggaagatgaagtggaatgcaaactgcctttggaggagatgagaatgctgaaagacgaacaggaaaaactggacagccgttctcccgagacggaagccattgttccggcagttactcctgccgacttgctcaatgtaggtgacgtgctgttcaatttggatggtgccggttcagatgaaaacaaatcataccgggccgccatgacactgcgtgccatccgggaaacggacatgttcgagttgttctcctcccagatggagaacaagaaactgatagaggagctgatggaaaggtatgtggatgaggaagggaatgctctgcctttaaaaaaagagaggaacgtttccaaacctgtcgcagactggaggaagctggtctgaaaaggcaatgtctgtcatgcccggaaaatcctgtacgcgttgaagtgtacgggatttttttatcatgtgcaacaggggtatcctgaatttgaccggctttgccgcccatatccttctccattcactttacataaagccgtacgatggatgacatttgatgacatctggtgacatatgatgacacctctgaatcacagcgtattattcccttttatcttcgccgtcgaattcaaatttatgtcttacccaaacgattcgacaatgaagaaaagaatccttttttcagtgatgtgcgcggcgattgccgccggtgctttcgcgcagggccaaggccagggccttgccggtatcaacgaggcgaccagcctcatgacctcgtatttcgatcccgccaccaaactgtgctatgccatcggtgcggtgctcggcctggtgggcggcatcaagacctacggcaagttctccagcggtgatcccgacacctcgaaaaccgccgccagctggttctttgcctgcatctttctgattgtagccgccaccatcctgcgttccttcttcctctaagcggtatggagtatcctgtaaataagggggcgggcaatcccgtcgagttcaaggggctcaagtcacaatacctgttcgtctttgcgggcggtatggtgacggtgcttctggcggtggtcatcctctacctggcaggcgtggaccaatggatatgcatccctttcgggaccgtatccggcggtctgctggcatgggcggtgttccggctgaacgcccgctacggcgaacacggtcttatgaagctgctggcggagaaacgccatccgcgctacctgatccaccgcaagagagttttcagattatttgcaaaaagaaaaaaacgacaatcatgagaaatgtattgaaagcggaaacgctggaacgcaagttccccctgctctcggtggagaacggctgcatcgtgagcaaggacgccgacctgaccgtggccttcgaggtggagcttcccgagctgtacacggtgacggcagaagagtatgaggccatgcactccacctggataaaagccgccagggttctgcccgaacacagcatcgtctgcaagcaggactggttcaccaaggagagctaccgtccccaaaacggcggggaggaacagagcttcctctcgcgcagctatgagcggcacttcaacgaaaggccgtacctgaaccaccgctgtttcctgtatctgacaaagaccacccgtgagcgcaaccgccggcaaagcgacttcagcaccctctgccggggattcctgctgcccagggagattaccgacaaggacatggcggcccgtttcctggaagcggtggagcagttcgagcatatcgtgaacgactccggccatatccggctgcgccgcctggaaacggaggagattaccggcacgagggaacgtcccgggctggtggagaaatacctctccctctcgatggaggacgaaaccgccgtactgcaggacatctgcctcaagcccggacggatgcgtatcggggacaagcggctctgcctgcacacactttcggatacggaagacctgccgggcaagctctccaccgacatgcgctacgagcgtatgtccaccgacaggagtgactgccgtctttccttcgccgcacccgtggggctgctactctcctgcaaccacatctactcgcagtacgtgttcatcgacaatgcgcagaaaatcctgcagatgatggagaagaactcgcgcaacatgctctctctgtcacagtacagccggagcaatgccgtgaaccaggaatggacggagatgtatttggacgaggcgcataccaagggagtgcttcccgtcagatgccactgcaatgtaatcgcctgggcggaggatgcggaggagttccgccgtattaggaacgacacgggcagccagcttgccatgatggaatgcactccccggtacaacaccgtcgacaccccggtgctttactgggcgggtattccgggcaatgcgggcgactttcctgccgaagagtcattctacacgttcctggagcaggcggtctgcctctttgccggggagaccaattacagaagttcgcccagtccgttcggcatccgcatggcggaccggcagaacggcattccggtgcacgtggacatttccgaccttccgatgaagcgcggcatcatcaccaaccgcaataaatttatcctgggaccaagcggcagcggcaagtcctttttcaccaaccatctggtgcgtaactattacgagcagggagcgcatatcctgctggtggacacgggcaacagctatcagggattgtgccggatgatccatgagcgcacacgtggcggggatggcatctacatcacgtatgaggaggacaatccgatatccttcaacccgttctacaccgattccggacagttcgatgtggaaaagcgcgagagcatcaagactctgatactgaccttgtggaaacgggaggacgaggcgccgaaacgttcggaagaggtggcgctctcgggagcggtgaacgcctatatccgtaaaattaccgagaatcgggaggcaaggccggacttcaacggcttctacgagttcgttgacggcgactaccgccggatgatagcggaaaagaaggtacgcgagaaggatttcgacatcgacggcttcctgaacgtgctggagcctttctacaagggtggcgactacgacttcctgctgaactccgacagggaactggacctgacaaacaggcggttcatcgtgttcgagctggacaacatcagcggcaacaaggtgctgctgcctgtggtgacgctgatcatcatggagaccttcatcgccaagatgcgccgtctgaaaggaatccgcaaggtaatattgatagaggaatgttggaaagcccttatgtccgccaacatgagcggctatatccaatatttgttcaagaccgtccggaaatatttcggtgaggccgtggtggtgacccaggaggtggacgacatcatcagctccccgattgtgaaggaggccatcatcaacaactccgactgcaagatccttctggaccagcggaaatacatgaacaagtttgagcatatccagcggctgctcggcctgacggagaaagagaaaagccagatactctccatcaaccaggcgaaccatcccggacgtttttaccgtgaagtctggatagggcttggcggcacccgttcggcggtctatgctacggaagtgagcgcggaagagtatttcacgttcacgacggaagagtccgagaaactggaagtgcaacggcttgccgaggagctggacggcaacctggaacttgccatccgccggatggcagagagaaaacgagaggaacaaagacaagtatcaatcccaaaaagagaacaatgagaaacaaatcccttatgagactggcggtgtgcctgatcggtatggccgccatggtattgcaaggctgctcggagagcggcaccgaccgtgacaagctctgcggctcgtggagcagcgtggaaggcaagccggacgtgctggtatataaggaaggggaagcctacaaggtgacggtgttcgcccgcagcggaaagatgcgccgtcttaggcctcagacctacctgctggttgaggagaacgggaatctgttcatcaacacggggcaccgcatcgacatctcctacaacgaggccgccgacgtgctgaccttttccccgaacggtgactatgtgcggaaggaggaacgcccatgaaagcgaagtcactcctgatcggaacggtactcgccctgtgcggcaccggcgccaatgcccagtgggtggtgaccgatcccggtaatcttgcccaaagcatcatcaacatgtcggacaacatcgcccatacctcgaaaacggcggtcaatacggccgacagctttgcggagacggtgaagatttacgagcaggccaagaagtattacgaccagttaaaggcggtaaacgacctgatacaggacgcccgcaaggtgcgtgacatcatcctgatggtgggcgacgtgtccgacatctatgtaacgaacttcggcaagatgatgaacgacgggaacttctcgccccgcgagctggacgccatcgccttcggctacacccgcctgctggaggagagcaacggcgtgctgcaggatctcaggcaggtcatcaacgtgagcacgctctccatgaccgacaaggaccgcatggacgtggtggaccactgctactatgagatgcgccgctaccgcaacctggtgagctactacacgagcaagaacatcgccgtgagctatctccgtgccagaaagaagaacgacctggaccgggtgatgcggctttacgggaatgaaacctccaaatactggtagccatgatgccgttgtcgatagattttgccaacctgcataccatactggcgaccctgtatgacgatatgctgcccctttgcaaggacatgatggacgtaggaaagggacttgccgggctgggtgccctgttctatgtcgccgtccgcgtgtggcagtcgatggcccgtgccgaaccgatagatgtctatcccctgctgcgtcccttcgccattggcatctgcatcctgcttttccccacgctggtactcggcacgctgaacaccgtgctcagcccgatagtacagggtacgcacaagatgcttgaggggcagacgctggatatggaacagtacagggcgcagaaagaggaactggaaagggaggccatgctgcgcaatcccgaaaccgcctacctggtgagcgacgaggaattcgaccgtcagctggacgagctgggctggtcaaccatagataccgcctctcgcctgggcatgtacgtggaggtggggatgtacaatctggagaagaaaatccgtgacgccttccgcagcctgctggaactgatatttgcggcggcatcgctgctgatagataccgtgaggacctttttccttgtcgtgctctccattctgggaccggtagcgttcgccttcagcgtatgggacggattccagtccacgctcgggcagtggttcacgaggtacatatccgtctacctttggcttccggtcagcgacctgttcagcaccctgctcgccaagctccaggtgctgatgctccaaaatgacattctggaattacagaacaaccccgactactcgatagacaactcaaatagcgtctatatcatatttatgctgatagggattatcgggtacttcaccgtcccgacggtggcgggctggatcgtacaggcgggcggagccggaaacttcagccgtaacctgaaccgcacggccacgaaagcgggcggtttcgctgccggggcgggcggtgccgtactggggaatatcgggggaagactgcggggcaaataggctctatggcaacccgtttccgtgagtcgggcaacttggattaccgggttgggcgacttgtcggaaggagccgcccggtcataccggaaacatttatttattcattcaaaccaatcattcgctaaatggaattcaagtcattgaccaacattgagagcagcttcaggcgcatccggttgatgctggctgtctttaccggctgttgtgcgctcgtcaccagctatgcgttgtggagctcgtaccgtttcgccgagaagcaacgggaaaagatctatgtgctggataagggcaagtcgctgatgctcgccctctcgcaggatctttcacagaaccgccccgccgaggcgcgggaacacgtccggcgttttcacgagctgttcttctcgctctccccgcagaaggacgcgatcgagcacaatataggccgtgctttgcagctggcggacaagagcgcctatcactactatgtggactttgccgaaaagggatattacaaccggctgatttcgggcaacatcaaccaggtggtacacgtggacagcgtggtgtgcgactttgccgtctatccctacaaggcgcatacatacgcccgacagctgatcatccgtgagagcaacgtgaccgagcgaagccttgtcacctcctgttcgctccagaatacggggcgttcggacgacaatcccaacgggttcatcatcgagcagttcaccatactggagaacagggatataaggagtgtggaacgatgagagggaaacctgccgtcttaaaacgtgcggacagccgtatccggctgttctgccgccggctgaccggaaagcagcgcattgtcttgacaagtgtcgtctcgcttctgtttacggcagcctgtctgtactcggttgtctcttccgtgtcccgtttgggggaacggaagggcgacatgaaaaccgggcatatccggcccgtcatgttacggccggaaacaacaaccattcattcaaacatccagaaacatgaaaatggactttcagaaaatcagggaacggctggggctgtcaagtgacaagccgctgactcccgaagagaagcgccgacgcgcgagatatattgtctatccgctcttctgcctgctgtgtgccggattccttttgttggtattcagcccgtcggaaaaggagaagtcggaaaaggaaaagggcaagggatttaatgtggagatgccctcgccgaaagattcggaaatggagggcaacaaggtaagcgcctacgagcaggaagcactggcaaaaaaggaaaaatggcgcaggggaaccttccaggaaatgtccgaactgctcaacaaggacagtcaggatactgccggccttaccgcaggaaaagccaacacggaacttccgccggaaccggaaacggagaaatcccccggctccgtccattcctctgcggaagcctaccggaatatgaaccgctcgctaggtgctgtatatacccggaatgaaaatcaacaaaatgccgatctgctccgccgtatagaggaactggaaaaagaaaagagaacggcgaaaggacagccggaaggacagaccttggaagaaaagatggcactgctggaaaagtcttacgagctggccgcccggtataatgggaagcagccggatgccccggctgccgtgaatggccggagcgaccggaaagacaggacagccgtccgcccggtgaaacaggtacggaatcaggtggtgtcatcgcttgcacaacctatgggcaatgaggatttcatcgccgaatttgcgggagagaggaataccggtttccatacccctataggcaggacactcccttccggcaggaataccatcgctgcctgtgtacatggtacgcagaccgtatcggacgggcaggtgttgcgcatccggttgctggagccgatggcggtggacgaccggctcattccccaagggacggtattgaccggcggtacacgcatccagggggagcggatggacatccttgtagagacggtggaatacaagggcacgctgtttccggtggaactggatgtatatgatgccgacggacagcagggaatcctcgtgccgaactcgatggagtatgatgcagtgcgtgagatagccgcgggtatgggcacctcaatggggagcagcattaacatctcgacggatgccggggcgcagattgcctcggatgtgggcaagggggtaatacagggcgtgtcgcaatatgtggaaaagaaaatgcgtgcggtgaaaatcaccctgaaagccggacaccggctgttgctgcactctcccgaaaaatgaaaagagaaaagaaaccaaccatttattcaccaaccaatcaagaacgcacatgaagaagattctgatgatgtttgccctgattatgggcgcagtgactgcatacgcgcagcaaagcagcggggattattacgagggattgagccgcaagatcggcttcagccaaatgattcccccgcatggtctggaaatcacgtatgacaagaccgtacatataattttcccctctcccgtaagatacgtggatttgggttcccccaatctgatagcgggcaaggcggacggtgcggagaacgtcatccgtgtgaaagcgacccggaaacatttccgcagtgaaaccaatatgagcgtgataaccgaggacgggaacttttacacattcaacgtcaagtatgccgacgagccgttgctgctgaacgtagagatgtgtgacttcatccatgacggggagtcggttaaccatccgaacaatgcgatggaaatctacttgcaggaactcgccggggagtctccccgtctagtacggctgatcatgaaatccgtgtatatgcaggacaaacgcaaggtcaagcacgtcggcagcaagcggttcggggttcaatacctgctcaaggggctttacgcacacggcgagctgctctatttccataccgaggtgaagaacgccacgcacgtgcctttcgatgtggacttcgtaactttcaagattgtagacaagaaaatcgtgaagcgtaccgccatgcaggagcaggtcatctatccgctgcgtgccttcaactatgtgacccgtgtggacgggaagaagaacgagcggacggtgttcgccctgcccaagttcaccatccccgacggcaagaagctggtcgtggagatgtacgagaaacagggtggccgccatcagtcgtttgaggtagagaacgaagaccttgtacgcgccgggactgtcaatgaactgaaagtaagatgagtgccatgaaaagatacttcatctttattatcctcctgcttgccctctttacggggcaggcggaagcccagcgccagctgccggggatgaaagccatccgctttaccgctgaaatggccgacggcttttacagccgggcagaccgccatgatgcgggctacgccttttcgctggctgttgccacttacacaaagaaagggaaccagtgggtgtttggctgtgagatgctacaacgtaataacccttaccggaacacgtatgtcccactgtcgcagtatacaggggaaggcggttattatcatacaatcctttccacatccggcaagtctttctttctgaacctcggcgcttccgccttgttgggctacgaggccgtgaacaacggaaaccgcctgttggatgacggagctgccttgcgcaagtgtgagtccttcatctatggaggcgcggtgacactggaagcggagggatacctgtcggacaggataaccctgctgatacgcctgcgtgagcgtttcatgtggggcggcgcatccggccgctgccatttccagtatggagccggaatcaaatacattttctaaccttaaaaagaacagaagcccatgaaaagaagaatccttgatatgatgatggctgcctgctgcatggcggtttccttccttggtcttgccgcttgtgacaatgaactggacattcagcaggaatacccgttcacggtggagtccatgccggtggcggatgagatagccggtgatgagacggtggaaatccgtctggaaatcaagccgtctggaaattttatcggaacggtctatacactgaggtattttcagcccgacggaaagggcagtctgaagatggaggacggcacggtgctgaagcccaatgaccgttacctgttgaacgaatggaaattccggctctactatacctcgcagagcgacaaggaggcgcagaccattgacctctattttgaggacaactggggaaacttgcaacagttgacgtatgatttcaatggaaaggaagcggaggaagacaataataatacggaggccgcatgaaaagaataccggttattatgatttttctgtcacttgttctgtatggcaaggcggaaaatcccccgtctgacaaggataaggcggtagcctgtatcaagcggtgggaaggctggcaccgggggaaaatgccttacatcggttttggacaccgcctgctcccccatgagaagctgaccgagaacctgagcgaggcgcaggcggactcacttttgagatgcgaccttgaacggtgcctgaaggtattccgtaaatatggaaaagactcgctgcttttaagtctgttaggctttaatgtgggctgttaccgtctgattgggaacgggaagatacccaaaagcagactgattcaaaaactggaaagtggcgaccgggatatttataaggaatatatatcattccgctgttatcgggggaaagtcattccaagcatagagaggagaagaaaagaggagtttgagctgttctatataccttagattgaaattatgcaaagccgtgaacggatgccggtcatcaccgttcacggcttttgtcttagccactcttaatttacctttacccggttcatcagctgccccgatatttcgtgcagctcccggcagcgttccggctgctgttccctcgcaaaggcggtgattccctgtgtcagtttccagagcgtggccccgcctgtcactccgtcgtcaggattgttgttcatcagcaacttctcgacctcgcgtccttcgtttttcaacaaggctcctttctgcaccagattcttcagttccttgtcgaaatccacgtctatttccgatgctccttgaatttcgatggccttctgcatgatggtgtctttgctgtacagtcctttggtcaggtcggaaacagccgatacggtggtctgcgtgtccagttcgtaggtcttttgggagagggacagggattccggcagtcggcctccaaggtgtatctgccgcatgacggactccctgaccatcccgttcaggcacgccccgttgagcaggaacgaccgcatgtccaccgagccgttgccatagtcggatgtggagaagcgtgctcctgcgaagatgatgaccgtcccgttcttacgggtgggtatctctatcggagtgggcaggatcgtttcgcaccatactttcgtgtcgttcatataggcgtcggacacgaccgccccctgtcctcccgcctcacggatgaaagcggtcaggatgtccaccgagttgagccggcggtaggagtccgacaacacgccacggacctccatacctaccgcacgtatcagtacccgtgtacgctcggtccatcccgaatgttcgttcaggatggtggcacacaactgtttctgccaggcatctccggcggaaagctcgcgcaggtatttggcgggaatgcccatcttctccgaaatctggcttatggcgttgccgtgcaggttgaagttcccttcgggcattgccatctgtacccttccttccgctttgaaagagataacggggcgttccttgctacgttggcttaccccgatgggagcgatgaaatcctgcgcgatccgcccctcactgagcagacggttgatggtgtccatgacaccaccttgcctgccttctatcatccgctgtaccttgttgatgactacctggttgagtccctgctgtttctgtaccggtgcagtggccggcatgactgttgcttccatattttttgtttttaaagttgataaattacaatttgttcttatggcttgtcttgcttgttttagtaaattcagatctgtactcttttgacagacggatataatccttttcgctatatccggccggtccgaacagttcataatatccggggaagggttttctttccgtttccggtatatgcgtgctggtttccttatggcaacagatgatgtgccggacaaaccggtagcacttgcaaagatccgccaggacggtgtactcgttgtccgtatgaggttcataatatccgcaggagagattgacgcaggatacttccagcccgttccttttcaatgccgccacatccgtagccagcccctgtgcaggcttgtaaccgtacttccggggatctaccgctgaaatgaactcattggagcatagcctcattccgttgatttgtgttaccatatccccgttccctttccggtcgcactggatgacgaaacggcagtcggaaaagaaggacatgtcggcatggccgctgcctatgcatcctatctcctcctgtacgaagaaggcacatttcaccgccttgaaatcctccaggcatttcaggcagatccagatgccgttcttgtcatccgcgccgattccggtcatccgtttacgcttgtgatcataaccgacaatcatcgagtccgccacaagatgggccgcataggagcctgtcttgcgccggtgtacctcgtccatgtgcgccacgacacaggggtagctttcccggttgcctttgaccgcgtagatgtttccgtaccggtcttgccggaaaggaatccccatccgcctgagttccccgatgatgaacccggctatcttcccctccttaccggagggggaggagatgttgtaaagagccattaatttttccatgatactgactttttaggagatgaacaacttttcgatttgcaggtaccgtctgaactccggtacgggacgtcccttcttgaagaggaaggacggatatttctttcccttgtattccaccgacgtgcctttcaatacttttccgaatacggtggatatatagaacatatcttgacaattcttgcagaatgccatatccggaaagggatgtatctttccgcatttgggacatacatattttctcctgtttgcgcacccttccgtgctccggcaggaggctatgcttgtgtcgccctccgtatttctaagttccagattgccttccgtcagatgaagactgtagaacgtgtcgaggtaaggcacccctttcttgtgccacctacaggcgggcactttcaccgtcaatgaaacctgtatattgtctccgaccgcccattcctgcccctcaatgggattcagtacggtgaaatccgttgtatgtgtataatcgttgtatctgcgtcgcaacaggatgcccgcctcctgcgcctgcttgcggatcagttcagcgacgaatgcgtgtgagaaatagatgcggtccagcagggaggcggcaatcggtgtatttattgatttccacaatgttacctcgttccatacaacagcccgtccgagtatgttgttgctctcgtcccttgccacaaggattttagcgccggcgaagttggtatagaagtcagcggcgttgcgtgccttgtcctcatatctcatacaggaactgtgcaggctggatgtgtcactgtcggcgatggggctgtagttgctttccagataggcttccatgaagtcgttcatgctttcatgcagcctgaccgtgactttgctgtccaatgagagggcgctacagaaataattgatttcgtcgggtgagtacttgggcaggttcttgaacagttcaacaaacgtggagggttccagaactgtacgattctccgggaaccagggtgcctgcgggttgttccggtccgggaaactgggatgggccaaatccttgctgcaggccgtgaacacgatccggattttcttgaacgtgcccgcttccgtccgcttgcgcttggtggagaagcagttataggtaccgcgtatgatctcttccaccggtacgttcttttttacttccaaaaggatgtctttggctatcacactcccgttttccgccgcatgcatcaggcgggatttcaattcattgctaacattcagtttcataatcattcggtttattgtttataaattctgccatgtttatatggcaattgtttcttgtccggctgcatttggcgcaatttctctttccgctttctgagcaggtcaacggacatgttcctgcttgtccgatattcctcctcgctcatccggcgaatggaaggaatgcccgtctgagtcagtgtatggtttaccatccagccgtccatgaagttttcggggaagaggctgtcatggtggatgacctcacctatgcagccatgtacgagcatgttgcaaacggtcatcaggcaacaggtacggttgacatcttctgcaaccagataattacccaggtggcgtacatgatatgccagcagcagccttccgcttccgcatgtcgggtcacagatacgttttcctgtcgctgtctcccccgaatcggtacataagaccatcaggtcgcagatatccggcggagtgaagaactgtccgttcacctgccgaccgcttttggaggatattgccatgaagaggtcaccgaacgcatcaaaccatccgccggattgcaattcccgctgcatgagccgtatccatccggtaagcatttccataaaatgcctgttctgctgccgtttgtatttccagtccataaggggcggtgcgccgggagagaacccgtgaacgatatagcgcaggaaatcgttgaaaacggatatcggatcgtagccgttcgaataggcgaaatcacagatcgttttctcaagcggacgtatcgcctgcggtgtgttgtatggtgccatattactctgattttttatagattgttactatatgtcttttatggtcagtctgtatcctgacgggagaaatgccaaggaaagagagatgggtgtccgctttcagcatgttccattcccatgcgggaagttccttccattccatacggtatgcccagagtatgaacagaccgggacggaatccgttgaaaagctttccgtgcagaatcccgaccagccgttccagttcttcccgcgagtaaagggtgaatgcctcattccgatagacaaaggcatcagccggttcaatatccggctgacactcgatgaggtatctcgtccattcttttgtggtgtactttccgtacagaggatcgggttccgtgtatttccatgccctgacgaatgtgtggaagaggacggcaccgttcctgtgccttccggtatgcccccacatccggaactgtttgctgcgtatgccatcgggaatcagcaattccggaccggttgtaacccaagggcctccttcggtactgtaaccggtacacttttcattttcatggcaaaaaggtgtctgtgggagaaggcagatatgaacttcccggtcatcgcccctttcaatgtgtgcctgcggataatagtcaccgccacgggtgatataagtgacaacatctcctgcagtcggtaaaccgactctttccctgtcctcccgcatccttgaaatcagccggttcaccttctccacgtcacacgcctttatggagcaggcacacccttcatgcctgttgagaagagtcagactttccaggtcataaaaattagcgtacttcatattgagatcgtttttgttggtacaatttgacctgacgggcaaccatgtcgcagaacttctgtccgttctccttctcacttctgaaacaggcaatcatgtcccagagattctgcttgaagcagccagtccatttttcgtaacagtgacttccatagacctttccgaacgtttcctcgaaaagtgcgggagtcggcccttcatccccatggtggttgtattgccacagggagacaggcagtagccggttataatccagtgtttccatatctgttcttttttaagtaaaacatcggcctacatgggtaggcatttttatttcttgatgtcttttcagtctgttttccggggattgcggcaaggcttggcgaaagaaaataccgcagcgaagcgaggatgattttctttcagccaacccagcccctgaaaggggccgccttgcacaatcagcccgggaaacagctatctttacagcaagaaatgaaaaagcagacctcggattctctgttctgaagtctgcttctcggtcattgtcgggtctcatgtttttcaggtatgtatctgccatccgtggaacggctgcaatgttacggcaaacgatctgtcaggtattccatgatagagcaggccgcccacgatacctgtccttccgtcgggatagcgctgtgtgaagccgaacgagtacggggcatggtcatagtagagtgagatttcgcagggataatcagggttttcttcccagcttttcaaccgttccagacatttttggagcgaggtgtcaccgatggattcggcataacgccttacattctcgaaatgttcttcattcaggattttcatgacttttgtatttttatctgttaaacacgtccggctccgggagccggtatttttatttctcgcctgcctgacagtcccgtggccgtacccgcaaggtttggcgaaagaaaataccgcagcgaagcgaggatgattttctttcagccaaccccgaaggggcctgaccttatacgggtacacaggacacgggactacctttgcagggtgggaaataaaatatacggttgttttttgttgtgggattttgtgtggattccttagataatcttcctgatttgttcgccattgccggacaaatgctgtatttttgcaatttctaatttcaggattatggaaaactatctaaagaaagcgacggatgctttccttgtggagcgtccgtatggtatgcgtgtggattacaggaagaaagggttcgtgctgtttaaccgcaacctgaacgtattgggcaatgtggagcatgcccgtctggaagagctgcctctggagcggttcaatgtggaggaaattccgttggagggtgaaatagtggaagaacatgcaggatttaccgatgtattcttctacaccgatttgaccaacccttatgccggatatgtgctgaacctacaaaagcttaaagcctataaccggttgatgtttccgctggcaatggcgctgaaccgtgagttgtgaggtcggaagatggtagcggtaacagctgcatggaacaagccgttaccgtcccggattttattgtttgccctctttttctgttatgaacgcaagataggcgggcacggccttatggcatccggtaaagttcggtgtccggcggcccttgattttccggaaactgatggttccgttcctgtcaatgcctcttacatgcctgttgaatgtccctttggttctgatatggatgtcaaaaccatcccttccggtgatttcaaggaacattcctcccgtgatccgttccccgtccaggaatttctgtttctgttcatcgagcagcagttgatgttgctcttcccgcgctctgcgctcttccgcctctttctcttcccgctccctgcgtttctgttcctgcttccttttgtatgcctcacgggcttgcagcaagggtgcggtgtcgagtccgagggcattgaacacacggatggagatcaatctgacgaaggctcctctttccgcgccctgaagcgtatccgcgatccagttcctgcaataggcggcggcttcctccctgcggccttctcctttgaggaaccggcgtgaatactgcccgctggaaaaataaacgttttcaatccggcagaccacatggaaacagtcatcgtcctcattcccatattcgttctttctcgacagggagagatatacattctctgcgtacggctccagttccatataaggagccacgacggtattcccgtcagacttgtacttgaatacttttgctttcatactatcgttcagtttgttggttgttgcatattacatctataatctcttttccgcttctttcacccttcaggaaggcaaggaagcgcctcaaaaagagccgggcacagtcagttcccagctgggagctttcaccctctttggtagcgcataccgcaaaacgccccagtccgaaactgtcctgttgcggtacgatgtggtaagacaagtcctcgcttgcgttgatgtgcaacccacgacggaaaacatagaaagttttcgggattcttctgtcggtatcgatttccatacgcttgtaaccgtgatgttccaataaccggaccagttccctgtttgtcggaattgtatgtccgatccagtccggccagcttatattttctagtatgtgtccgtaattgtcatataatatattgaactgatcctggtattcatcgtaaaattccccgttcccgttgcacatttcctccaacgcgatgccgtttttacggacaagggcaaggtcgcccagtccacacgcgatttcattgagcagcgtgcgttcctcgtccctgtcttttgccgttccgtaaattctaagcagggaataccggtgtagcgccgaacgggatggcatatccagtttttcccatatctcatcgtttcctatagcctgtttggtgttttccggaagtccgtaccaccacttgtccaaattgtttgtatccataatttctgaatcagattgttttcaaattctgttttgagtaccatgcctgatacgcggcggcatactcctgacgttcccgctccagggaatctctcatcttcggggtgtacccgagcaggcggatgtatcctccgttataaccggtgagttcgcaccttattccggcttcctccagtttgtcgatgcgtttttgggccatttttgcgcttgaatattccttcggccaaaaatagagttcgccccgtgagccgaaacagtcttcccccagaattatttccccggcatacttccggctttcgatgaagccgaaacgcgctttgcccaatgcccggcgcattgccttgtgtgccggaccttccggatgcttgaatacctccggtttgtctttgctgtcgagtctgggcggttccaccttgtacggctgtttgtaacttccgattccaagtgtcaggtaaaagttggtgtgaaaatagtccgtcatggggtcgctgtcgtcgaaattgtacgacatgatgaaatcgcagatattcatcattacatcttttgccctgtccgtcaagtatttgtctgaatcgatatgatagtggttgacatcgccttgaacttttccagactctttggtgaacgcctcgaaatccgctttcatcaaccggatatggatggagtggcaattctcccgtctgacagagaacttgtatcccggataggtctccttgagccatgcccgtaccagtgccacgatttccggcgcatgctgccccttgtaattgcggcctttccagcggtattcgttatacacatactcggtgtattcctttgccgtggctcccgaatagtcatattcatatccggttgaagtcgcgggaatatccggtttgtctttccaagcctcaaaaagccttccaaactcggtgttcacctgttgcatgatcgcagtgtcgccacccttgtccgggtggtgctccaatgccagccggcggtattctttcttcaagtccgccagagagtgtatgttctgaaaataagtcatagccatgagttttttatgcccctgcgaggcggttgataaaatattcccggtagtcaaggtcaagaccgaggttgagacaggccatttccatgtcatcttccctcaaatcatctgcctcctgcaattcgcgcagataccggatttcggagtccaggtactcccgtgcttccgtttgactgcaaccgcatgagctgctgatcagactgataatgtttccttgcatactgtttgatttttggggttactgttcctttttctgaagcgtcgtccgtcatatatcgagacggcccgttccaccagaatcctgcggttgtcttccgagagttccaggtagaaccgttccgccgcgccgaatgtgcccttgcctgtcgccacgcaccatttttcccagaaatgcgggtacatgccgccatacacggctttgcattcctcctcgctccaggcgttccacatgtagtagaagaaactggagacggtattttccgcttgatatttcatggttcttctatttgtgattctacattgtttgtttctctcagttgatgccacacagcctcatacatctcatgaagccagtctatgttctttgcgccgagttcaaacgggctgtgacactgcacctcgtcaccgctttctttctcttcggcaaggacggtcaggctgtccgccgttacccggagtcctgtcaccctgcattcatatagttctccgttcttgccaaaccatatcacccagaccggatcataatcctcttccggaagacgaatttctttcacgcagtgagtatggagcaactgccgtatcgcgtcgatgatgtccccccgcagttccttgatcctgccgctgaaatcaacggcttctgacggtaaacttccttttccgcctctttcctgcaaggagagaatccgcgtgtcgggatggatacagaaatcccagtccaacacttcatcgtcatcgcgtgtcgtgtggatatcgccgcccaaaacaagaccgcaatcgtcatttaccattctttttgcttcatcgcggtcttctgccgctaccgtgtaagtgccctcgaaggaataccttactcttatgtcatatcttttcatgattctttccatttgattgttgataccagattcattgcccggaaggattaccggatattcaatattgcgctaaaggcatgtgggtcaagcctgtaaaacgtcggaaggttaagtgtgaccatcgggtagcttacccagccgctctgacgtctataacctgtatcctcagccaatttgttggacagaaggaactccatggcatcaggattgttgttgatgtccacgaatgccctgtcaggcagtgagaatgccgccttatcttctaagttgaccgtcaggaccgtgtatatctcatgggtcacgggatctttcagagacaatgccggccagccgttatggtacatttcaatcacgattgagagacggctttcctgatacaggaaagtctcttccatggacggatggtcgcatttgacaatttcaaaatcatcctcccctttggtaaatgtcaccatcggataggatacatcgacaaaacattcctcttcccggtaacagagatgttcttttccctttgaacggattatagctaattgggtgttcatattcgtaactggttttaaaattattgacttgcaagttaattggccggcattcatctgcctgtttctttaaacgtgtgattgtcaccgcctgcggacatttgggagagttgctgtttcaccgccttgattttcccaatcagttcgtcctcccttcggaatgagggggtacatttggtacgcctcatcccggctccccaggggatgtcgccgcatacttttctcaggcgtgccttttcgctttccagagccgactccagacgggccagcctgcgtcgcaacgattcttcggtcacagttctcatgatctcattgttttttttgtatggtgacgggtcggaaagacagtcaccataccgtcgttatgtgtcacgttatattttagctttttcccttttgatgcctctcaggacgtacaacaggtgcaggaacagctccctgtcgtaaatccggaagaagaacggctcgcctgtttctctgaccgttccggtaaacgacacggactcccggttcacgggatattggaggaagttgccatttgccagcagggtgtgctttttcttcatcacttcgcctaggaacttgtccatatcgtcgtttccctcatagccggagaagtagaggaaatgatgacggcgcaggcttcgcaggattttggcggtttccagccttacatccctgcctgacgattcgtccgttcctctcatcaggttgcagatgaacttcttctcgccatttatgtcaagaaacagataaggaactataattatagaggcatgccgtgcgtggtcagagatgaccatcggcttttctttcaggatgtctcctttgaaggtaatgttccggtaatggttgtccatctgccgttccagttcctttcttggcgtggtaacggagcggagtcccgtgaagtagcgtccgcccgcccggaagcagaaccggtagatgtccgcatgataaggctctcccatgaaaaagaaattccgggtatggcggatggggggcaagacatccatgtagtcgaaatatctttcttccgtaatctcactgaacggggcgcagagggattgcaagtagatgcgtatcatcttgcggacggtatttctggacacggctatgaggtacgggttcttttccctgtccctcagttcctccaatgtctcatgatggtagtcgccatgtattccgtcagacatggtggtcacgcagctgccgtcaaaactgcgtgaatcaactacgaatttcagtttgtcgttattcatggttcagatgttttgaaggttcaacactctcttggcggcactgagggcattggaggtgagctgccgttgccatgccttgtttctgggtgaccagcggaatccggaggatttcagtttctttcgtctgttgtcttcgggaatcctgtcaaacaggatctgaaggcggtcttccccatagttccatacaagtgtcccgccctcgaacggcacttccttgttttcccggctttgcaccgctttcagcctttcgcgcatccgttccgcaagttccggcaattggaagaatttgtttcttggggtgatgacgggtttccttacccttgcgttatattcggaaatgaagtccacggccctgcggacgatttccacttccccgtgattggcgaaggtggataccttgttcaggatgctgctgacgaacagggcacggttataaccccggcattgtccggtgtcaatcccgtggatggtgtcggcgctgctcttgatgtcgcgtttgagcgtctgccatgccttttccagtttttcttcctccggtcgtgcggcttcatttttccgtctggcggcttcaagaaccttttgccgccaattgcggaactcctcgtagcggttctgatagcttctgttcgtattctcctgcctgtggtaatcgaatccgccccgtcccgtcaccatcgggttggcgcagcgtgagagggccgagagctgggcggatagctttttccggtaggcggcgatgtatgtatcccgtttctcttcctgcatgagttgcaggtcgttgtgcagctcctccccgtaaatcatgatgtccgtctcgccacgaatctccgggtcgaaggaactccaggcgtatgcgtcgcaagcctgtttccacatatcctccagatagccaggatgtttgaacgctacggcttcccagtctttgaagtccctggaatgcaattcattccgatcttccggatttccgtacaggtgtacatagttgcccgttccatgatgctcctttctgaaatggaacggtacgggaggatggtccgtacccttttcccggatcatcgtgacccggtgcgcattctctgcggtaaggcccgttacttgttcttcccggacctttgctgttgttgtttcagtcataaccgttgccattcataaattatttctaccagttcttcgtccgccagtttttggatttcctcgtccgagcaatagcaggcgatttcctcgtccagcttgaaagctgccgggtcaaggcttctgatgccgtccagcagttccggcaccaggctgtctgcggcaaccgtatagcttccgtccctgccttgcaccttccgtgcgggatagctcctttcccgataaaccaacattctcattttcggattggcaccctgctgtcctttgtggactttgcttgttgtctctctgttcataccttcatttttttagtttgtttgacatgatcggctccgtggagccggtttttcggtttcttacttgccggactgtcctttgccggggattgcgcaaggcttggcaaaagaaaataccgcagcgaagcgaggatgattttcttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcaaggcttggcaaaagaaaataccgcagcgaagcgaggatgattttcttttagccaaccagcccctgaaaggggccgccttgcgcaatcaacccggcaaagggctatatttgcaggtaagaaattgaaaggacggcagggattttcaatttgccgaatattgtaaagatattttatacgcttttgtctttttgtgcttatattttatatactgacatattgtctgaatgactgacataatatcgtaatatcgtcaaatttaagattgtttaggcttataaatttgaacagacattattattgaataagatttagtgtactaataataaatactcctgtgtcttgttctgtaaaaactctaatataaatctttggcataaatattgtaaaatttctttttgatttaatttaaattttagtaatgatgaataagtatgaaaaagaagcaagagtttatccagctatcgcaggaatgataattcctattatcttgactacattgtatgtcacatcgtttatacccaaaactttggacatgtgggagtcaataattgcaaaaatcggattgtttatcccagtggctttaatttatggtgcattagcctattggattcgtcaactgtttattgatgcttctaaacgattgtttcagtttcgtttgtttaaagaagatgaaactgagatgcctacaacaaagcttcttctttggagtagcgatgtgagaaagtctgaagctgatataaaacggatagcggaaaagataaagacagattttggcattcaactgctatcaaaagatgaagaaatctctaatctatccgaggctaaacgcactattgttgatgccgttggaaagataagggaggtgactcgtaataatgagaatcttcaacagtataatagaaaatatggattctgccgtaactatcttggggcttgtgtatatgctacaggcgcaattatccttgcacttgctgcaaattttatcttagatatgccatatgcaagcgtattgtttatggctttaggggttcagattttattaggtattatagattatgcatcttacaagtctaaagcctatgattacgctagagcaatgtataatgcatatacaactggtacagagtatgaacgagaataaaaatgtattaaaatacgagtatgaagttctgaaagtgggagatgctgacgcgatacttatcagacactatattaacggtaaaccatttatcgtactgattgatgcaggcaatgctggtgatgctgcaattataaaaaagcatcttggagattattataacagttactatatagacttggcaatatgtacacatccggatagtgaccataaagatggattctttaatctgcttcaagatgatgatattattatagaaacattctggttaaccgatcccgctcaatatcttgatgtcaatgacatacaacgttacagaagcaaagagaatgcaacaaaggcagtccgtaagatttggcaaaaatctacagatgccaacctaaaccttattgatttagcattgaacaaatgcgaaaaggtggaaagcgtaactgatggagctaaacatccaatattaccaataagtattgttggtccttccgatgaatattatgccgaggtagtaaaggcaatggtagctgactatggtgttaagacatacgaagatagttcaaaagaagcatatgacaatgtattcaagattgacgaaaaggatataaaaagtataatcgataatgacgaagatttatctccgtacaatgcttccagcctcattatcttatacgaaccgggggatggcaaaagattactctttgcgggagatgcaaatactacctctcttcagatgatgctgaacaaatataaaaggttgagaaatgtagatttacttaaagttccgcatcatggaagccgtagaaatctgaatacgtcaattatagaggctctttccccgaaaaaatgttatatatctgctgcaggcaataagaaacacccaagtgggcgtttagtatattggcttgcgaaatatggggatgtttactctacccatacttgtaattcctatatacattgtcagtcgggggctatgccaaatagaataggttgtgtgactcttattccattaaagaaaaaaataatatcataataaactaattagggtgttcagttctactttccaaaaatgtagtatcaaaacaccctttttactttgatataaggttttgatatttaatgttatagcacgtaaagtaactctttggaaagttgctcagcactttgagttttagtagcttggtaggacgatttaagcaactaagaacaatgaaaaagatcaattcaactccccataaagaaatcttagcagaggaagtcaaacgtctgtaaagacaatgccaaactcaagatttaaacttaatgaaggaaggagcttaaataagcctgcaatcattgtgtactattttattttttttctctaaaagtggtttatattgccagttggaattctagtaataaagatcaaggttaaagcaattatttttaggtaagtaattggataacaagcagtctaaaaaaagaaggtaccctttccagataccttcaatgacggtcggttgtatatttaccgttctaggcgtttctttacgttgttcattgcctctttcaggctgctgttcatgactcgtgcataatgttgtgtcatacgtgtggaggcatggccgagcatgacggaaacatcttgaagaggcacattgttggcaagcgtgaccgtagtcccgaaagtgtgacgggcggtgtgggaactcattagcatagcaacatcaaatagaacagcgcgttagaaacataatctgttagaaatgagctacatttcattatctggcacacctttctgaaacggattcagacggaatgccgaatcggttccgtttcttaaccgttaacaggttgtttcggaaacctgccgtgttaaccggatgattgaaaaaagttctccgacgggttgtttttctatgatactcagtattttgcgtagcgatgaacgcttacattcataataactttgcactcaaaaaaatgtaggcgtatgaaaattgagaaattcaaggtcttgctgtttttgaagaagaccgaacccgacaagtcgggcaaagctcccatcatgggacgcatcacattgaaccggacggtggcgcagttcagcaccaagctctcgtgcacgcccaagctgtggaacgtgcgtgaaaaccgtctggaaggaaagagccgcgaggcggtggagaccaatgcgaaaatcgagaaactgctgctggccatccatgcggcattcaatgaattgcaggaacggaaacgcgatttcggcgctgcggacgtgaggaaccttttccagggaagcatggaaacccagatgaccctgctccggctgttcgaccggcacatcgaggaaacgagggagcgcatcggcatcgatgtgtgcgcgtcctccatgagcacctaccattatgcgcggaaaacgctcggcgagtttgtcaggaaaaaatacaaggtgaaggacatcgccttcggtgcgttgaacgaacagttcattcgggaataccagtcctatatcgaagtaaaatgcgggtattccaaccagacctcacggcatcatctggccctgctgaaacggatctgccggatagcgtacaaggaagggttctccgagcggtaccatttcctgcatttcaagatacccaagcagaaggagaccaccccgaaggcgttgagccgcgaggacttcgagaagctgcgtgacttggaaatcccggaaaagcgccgctccctcgtccttacgagggacctgttcctgtttgcctgttatgccggaaccgcctatgcggacaccatatccattacccgcgagaacctcttcaccgacgatgaaggcagcctgtggttgaaataccgacggaaaaagaacgaactgacggcgcgcgtcaaactgctacccgaggccattgccctgatagagaaataccgggacgatttgcgggagaccctgttccctaaccagctgtacagtacgcttcgggcgaacatgaaaatcctgcgcgtgctggccggactgacgaccgaactcgtctatcatatgggaaggcactcgtttgcctcgcttgtcacgctcgaagagggcgtgcccatcgagaccatcagcaagatgctgggacataacaatataaagacgacccagatctatgcccgagtcaccccgaaaaagctattcgaggacatggaccgcttcattgaggcgaccaaagaccttgaactggttttatgagaaagggttgtaaaaacgagattggaaaaaaataaatgtagaacatcagctaaaatgaaccatcatgcgtagcactttcaagatattgccctatatcaataggaaaagaatcaagtccgacggcacgaccgccgtcctttgccgtgtgtccatcgacggcaaaagcatcctcatcacgaccggcatcttctgccgtccggaggattggaacagccagacgggaaccatccgccagccccgcgagaacaaccgcctcgcagaattccgcctgaatctcgaacgggcttatgaccgcctcctgaaagaacagggcgcagtcagcgccgaactgctgaaaaacgccgtgacaggtgtggcgaccattccccagacccttctcaaaggcggcgaagcggagcgggaacggctcaggctgcgtgccgaacaaatccattcgacttccacgttccggcagtcgaagaccacgcagctcaacctgcaacagttcctccagtcccgtggcctggaggacatcgccttttccgacatcacggaggagttcggccattcgttcaaactgttcctgaaaaaggaactgggttatgcctccgggcatgtgaaccactgcctgtgctggctgaaccgccttatctatattgcggtggatgagggcgtgctccggtgcaaccccttggaggacgtgcattatgagaagaaggacccgcccaagatgcgccacatcagccgcagcgagctgaaacgccttatggccacgccgatgccggatcccaaggtggagctggcccgccgcatgttcatcttctcctcgctgaccggtctggcgtacgcggacgtgtataacctgtacccccgacacatcggcaaaacttctgagggcaggctctatatccgcaagccgagggaaaagaccgaggtggagaccttcgtccccctgcacccggccgctcggcagattctggaactgtacaataccacggacgacacccgtcccgtgttccccctgcccaagcgggacatcctttggtacgacattcacgggctgggtgtcatgctgggcatccagaagaacctttcccatcacgccgcaaggcacaccttcggtacccttttggtctccgagggcatttccatagaaagcgcggcgaagatgatgggccatgccgacatcaacagcacccagatttatgcgcagattaccgactgcaagatatcgaaggacatggaccgtctgatggaacggcgcaacagccggaacgaaatgccaatggatgaataacaaaaaagtcaggaatcatggaacgttacattatcactttggacgaacacggcacacttcacgtgccggatgtttccgcaacagccatctggatgaatgaaccggaactgatggaactgttcggcgtggttgccctcacgctccgggcggcgataaaggccgtgtacaagagcggcatcctgaatcccggcgaagcggaacgtcgtgtccgccaagcggacgggtacgggatggacgtgctgtacggcctcccgttggtcattgcccttgccttccgccttcatacctgcggggcaaaacgtctgcgagaacgggtcatcggaaaattcacttgccacggtggacggaataccgcccgcctgttcatctttccggtcagtccgcattggcaaatggtgcggaattgaccgtattatcaactcacgcacaataaagcggcgcatcatgagaggattatctcccgtgatgcgccgctttcgtacattcctacaggtggccgggtcatttgcaagtgttttttgcaaataccggaaagggtggtccacttttcaatgcgtacacgacttctaccgccacctacatttttcccatgtccttctcaggttccgatacggaatgcctcccgataaccctccatcagcagccgttcgatatccgactcccggtacaggattttccctcccagctggatataagacatgcgccccgcatcccggtattcctgcaatgtccggcggcaggtcttcaacaatttggccacttcccggtctgtcaggtagcgttccccgcccaatacggggcggtagttttcggccaataattcaatgtggtccaatgcgtgctccagcattctgaacagcgcggccatctgtccgctttcccttgtcatcaattcgttcattgtcagtctgatttaagtgatactcatttaaccttcctcaaatagtttttcctttcaaggccgccagggtgcggcgttcctccaccagcggcacgatgcgccgcacgtcctccgcccggtagaacatcttgcgcacaatctgtgagtaagccagcgtgccgttgtcgcgcagcgtctgcaaggtgcgcgggctgatttgcaggatctggcacacctccgtgctgtccagccattcactgaggcgtttctcctccgccttgcggcagaacctgtccaccattccggccagccggttgaaacgcgccatcaattcctcaaaagtcttttgctcgattacgattacattttccataagattaccgtttaattgtgattatgccgcaaagtaaacggaattacgggcagagtccaccgcttgtcaggcgcgtggcagcatttggcgttgtcgtggcagccgttggcgttcttcgggtacatctatctccccatcattcctgttccagtccctgccccacaccttatatataatatatggtaaggcaagacaccttatgtaccttgagggatggaaacagcggcataaaagctttttcagacctgccggacgggacttttcaaaaaaatcattgccgactcggtaacgactatggaaaacgcctcttgcacaataccgatttttgcagcgtaatcatcaacaaggaacgatatggacacagagaaagtgaaacagaacccggccgtggaagcggcgggaagcagtggcgggcaagccgcaagaatcttcaagaaggagaatatcccgaagacggcggaaacggtcgggcgggacaccttcgaggaatggatgggacgcatcatggaacgtttcgaccgccaggaccggatcatctcggtgctggtgaacaaggatgccgccggagtgaagtacctggacggggaacggttgtacgacaaccaggacctgtgcgagatgctgaggacaagcaaacggtcgctgcaacgcttccgaagcaagtacaggctccgttaccaacggattggtcacaagacctattacaaggaatcggacgtgctggagttcatcagccaaaatatggaggaagtgctgcaaggcggtaccaaggtgctccgcatgaaagagcaacccggcatggaagccccaaagaacaaatccggcaaaagaccgggccacaagaagtattcacctaaaaaataaaagtaaaaatgatggcaacggaaaaagaaaacatggccatgacggctgaaaccagagaacagaaaccgagtatggccacctgcaaggaagccttggcggattacaggcggatttacctgcccgtgcctgccattgaagaccgcaagccggtattcctcagcaaggagacccgtgacaggctggaccggatagtccggttgttcggtgagcggaaaatgagcgtttcaggattgacggaaaacatcgtccgccgccacttggaaatatatgagaaggaaatagacgaatggcgcaagctgtgattttgataacccattaaaaaacatcgaaaaaaatggaacagaaaaagaaaaagcaagaggacgtgctggtcgtccgcgacgagaaaacgggcgagatcagcgtggtcgccgggctggacggcaagggctaccccaatacgaagcccgcgaagccggaacactcgcaggacttcctgcgcttcgaccgccacggggacatggtggacaatttcttcaagaacttctaccgccagtgcaaggagccgacgcgcttcggcttctatcgggtggcggcggatgcggtggacacgctgcttcccgtcatcaaggacttcctgaaagaccccgtggcaaacgcggagatacttgcctcgcacaaggtggacaccgccaagtaccagcaacaagcagaaacagagaatgtcaaacaagaaaaaaataacaacgaacccattaaaaagacagaagaaatggaaaagaaagaagaactgaaacaagagaaggatgttcagcagccacaggtagctgaaacacaggagaagcctaatctgatagcggacgaccaagtaaactgggaggaactgcgcaagtgcggcattgacaaggagaaactctcggaaaaggacctaaaagccctgatgaactacggcaagacgggattagtgacggtaaagccgaccttcggctatgagagttacgaattgcaggcccgattgtctttccagaagatggaggacggctatctgaagctgacaccccattttatccgcaatgaaccacgccttgacatcccccacaggggctacaccttcaccgaagaggacaagaagacgttgaaacgcacgggcaacctcggcaagcccgtcaacttcgccaacgagaagacaggtgaaatcaagccccactacatcagcatcgaccgcctgacgaatgaaatcgtggacatccctgccgacaaggtgcgcatccctaacaaaatcggacagaccaacctgtcaagggaagagcaggacatcctacgtgcgggattgcctttgcccaaggaagtgatgctctccaacgggcgcaagttccaagccttgttgcaggtgaacgccgacaagcgcgatgtggagttcgtgccgggacaaccgaggcagcagcaatcccagcgtcagggaaacggccaaggtaaggcgcaggacaattccaattcgccccaacagtcacaaggtgaagaagatgggaataaccagcaacgccgtaaccgctcgtggacaaacgaggacgggagcatccgccccatcaagaaatggaaagacgatgtgtttaccgaccagcagatagccgactacgtggcgggcaagacggtggtgctcgccaatgcgaaggacgaccaaggccagccctgcacgaagtacctgaagttcaacttcgagaaaggccgaccgctgacctactcgcagaaccccgacctcgcgcagaccgtcgcaccgtccaacgagagccggacacagctcgccgtgaacaacgaagggaagaccaacgaagcgaccaaacacgtgaaagagccgttgcagcagggtcagaccacgccgaagaatgatgcgcagcagaagcagcaggccaagaaatccaaaggcatgaaagtatcttcctgattgccgccactaaatccatccgataagtattgacgggctgaaacggggaacatgcaccgccttgtgcgcatatcccacaaacaatgccgtgccccgtttcatccccattaaagacaaaagtatcaacgaataaaaaaacagagaaagacatgattaccatattggcagaaaaaccgagcgtcgcccgtgagatagcacggattgtcggcgcgatgaaaagggaagaagggtatttcaccgggaacggctaccacgtgacatgggcgctggggcatctggtgcagcttgccctgccagacggctacggcatcaagggcttccggcgcgacagcctgcctgtcattcctaaaaacttcgagcttataccccgacaggtaaaaacggacaagggctacaaggcggacgcggcggcggtgaagcaaatcaaggtgataaccaagctgtggaacgaaagcgatggcatcatcgtggcgaccgactgcgcccgtgaaggcgaactgattttcaggtatttgtattcctatatcggctgcaccctgccgttccaaaggctgtggataagctcgctgacagatgccgccatccgcaagggattaaagaaactgaaggacggccgcgaatacgacaacctctatcaagccgccaaagcccgcagcgaagccgactggctggtaggcatcaacggcacacaggcgttgtcggtggccgccgggcgcggcacgtattccgtgggacgggtgcagacacccacgctgacgatggtctgccaacgtttttgggagaacaagcgtttccagcccgaaccggtataccagctccatttcaccacgccgtcggtgagcgtggatgaggtcgtgaagttcgcctcggtggagaaatggaaggacaaggaggaagccgccatactatataataaggtaaaggaacagatggcagcaaccgttaccaaagtcgaaaagagggaaaagatagagaaccctccgctcctgtacgacctgaccacgctacaaaagaaggcgaacacgaggcacggcttcacggcggaacagacgctcgccctcgtgcagaagctctacgaggcgaagctcgtcacctatccgagaacatcaagccgctacatcccggaggacgtgtttgacgaagtgcccatgctgttcgaccgtctggcaacccattcttcctttgcggagaagattggagccttggacggactgaaccgccgcagcgtggacgcctcgaaagtgaccgaccaccatgccctgttggtgacacccaaccgtccattggcgctctacaaggacgagcagaccatctacgacatgattgtggggcgcatggtggaagcgttctccccggagtgcgtcaaggacacgaccaccgtccgggcggagtgtgagggcatagcgttcgagacaaaaggctgcatcgtgcgcaaggcgggctggcggtcggtctatggcgaggacaacatagacaccgttttgcccgactggaaagaaggtgatatattggcaatgagcggctgttcgatgagttcgggcatgacacgcccgaagccgttgcataccgaaagcaccctgctggcggcgatggagaccgccgggcgcgagggcttggaggacgaggaagcgcggcaggcgttgaaggactgcggcatcggcacgcccgccacccgtgccgccatcatcgagaccctgctcaaaagggaatacatggtgcgcgtgaagaagtcgctcgtgccgacggagaaagggcttgccctgtattccatcgtcaggggcatggacatcgccgacgtggagatgacgggacgctgggaggcggaactggcggagatagaaaaaggcaggatgccgcacgaggcattcatccgcgacattgaaagctatacccggaaaatcaccacggaactgcttgcctcggacaagctgttcgggcacaaggcatcggactgtgcctgccccaagtgcggcaagggtacgatgcagttctacggcaaggtggtgcgctgcgacaacccggactgcgccctgcccgtgttccgccagatggcgggcaggacgctcaccgacgcggaaatgaacgaactgctggcaaaaggcagcacgggtgtcctcaacggcttcaagagcaggcagggcaagccgttcagcgcaatggtcacattcgatgcggatttcaatacaaaattcgtgtttcccgaagccaaaggcacaaaaaaattcactaacaggaaaggaggaagaaaataatacgtaccttttaataaagtaagctgcatctcggaataaaaaataagcgagcttattttgttctcccctcgatttgcattacttttgccactgattcatgtcataatctgtttcaattcgttgatactcgttattcacatggatttagtggcggcactcggagggataccgggtgccttttttcttctttcctatccattccacaatctgatttttcaccactaaatccatcagaaaatgaaacagaacaagaaaaccgtcccagcggaactgtcctactacgggctgtacctgctggactacctgagaaaataccatcccgacaaagtttccgacacgtaccttattgcagagagggaggaagctgccgccaccacctttgaaaaagaaaggtcggcaggaagtacggtcgagtatgcccacgaggaagccatgcgcgtcctgctgcacgggctgcacttctcgccctacgccctgctgcgcgaggtcgtggaaaacgagttcgccgacgaggtggcggaatccggccgcgaggcgttctgcaacgagctttatccctacttgacaaacctgttcgccggttacgacacgtcggacgacaccttcgccctgtcgcccggacacgacctgctctacacggagctggtgggaaccgtcatgctttatctggagtcctatggcgttcaataggaaacagaagatgcgcgacaacatcgaggcggtacgcacggcgttcacgctggaccgggagcggcgcacacccaccgagagggaacgtgcgctattagagcgttactgcggcttcgggggcctgaagtgcatcctgaacccggcaagggaactggcggacgccgcgcgttgggcgaagtccgacctcgaactgttcgcgcctacggtggaactgcaccgaatcattagagagaacagcaaggatgaaacggagtacaaacgctacgtggactcgcttaaagcctcggtgctgacggcgttctacaccccgaaagcaataaccgacaccatcgcggacgtgctgcacgacaagaaggtgcgccccaacctcgtgctggagccgtcagcgggcatgggcgcgttcatcggctcggtgctgtcggacaacccgcaggcggaggtgatggccttcgagaaagacctgctgacgggcaagatgctgggacacctgtacccgcagcagaagatacgcacggagggcttcgagaagatagaaaagccgttcctgaaccgttttgaccttgccatatccaacatccctttcggggacatcgcggtgttcgacccggaatatgccaacggctcggtgttcaagaagatagcggcaaggaaggtgcatacctatttcttcctgaaagggctggacgcggtgcgtgacggcggcatcgtggcgttcatcacctcgcagggggtattgaatacggaaagcaacggcggcacacgctacatgatgacaaggaaagcggacttggtgtccgccatccgcctgccgaacaacctgttcacggaagatgccaacacggaggtggggtgtgacctgataatcctgcaaaagaatgaaggcaaggaggaactttccgaggaagacaagaggttgggcgatgtggtaaagagcaaccacacgaacattgtttccaacgggtatttcctcgaccacccggaacgcatcatccataccgacgcgaaaagggacaccgacccttacggtaagcccgctatggtttatacgcacagcggtggtgtggagggcatcgcaacggatttgtaccaaatgctgtcggcggacttgtcggcacggctggacttggaacgctataatggcatcaaggaaaaaaggcaggagactcggcagacgattgtcgtacaacctatgcagacggaggcgaaaaaagaagaaaagtcggtacagttgaaagcggaaccggtgcaagccgtggctcaggaggtggaaagcaaacgccccgaagccccggttatggacttgtacgacctgttcggctacacgcaggaagagcggcggttggcggaacgggggctgaaaccggaacggaagaaaagcggtaagtccaaagggaagaaagccgtacagccaacattgttctccctcccgaagagcggaaaggaggaagcggcgaaaaaagaaagcggaaaagtgaaagccaaatccacagaagcggcttccgacatcacgtccttgactccggaagaagcgcaggaaatggaggaaattatccgcaacaggatggatgtgccgcaagcgtcccgacaggaaaccgtttctgccacttcacccgatgtgaaagacgcttccgaaaccacagaggacgatgacccggaggatgccatctaccgcagtctggactgggagaccaacccgcccatcaacggcttctatgaaatgatgatgtcgctcacgccggaacgccgggcggaactgcgccgcctcggtcgggagaagatggatgccaatgcagccaaacaggcggaaagggcggcggaggcgaaaaaagaagaaagacaggctacggaaatggagcaaccatcgtccgtgcgcccattttatcccgttgagaacggttttgaggcggaagggaaagcgcaaatcgagcgtgtggaaagggaaatgcgcgaggaagaagccgccttgacacccgaagaacggcaacgccggaaagaggaagcgatgatgccacgcccgttcaagggcatcatggagccgcacttgaaagacggctctctggtatgggaacacacaggcggcgtccgcttccaaatcggggtgctgagggatgtcaccaggtacggggcgactttccagccgctcgacatggaggggatgcaggcgcagaaggcacagttgtacatcgacctgcgtaacacctacgagcggctctacgtccacgaagcggagaaccacgaggaaaacgccctgctgcgccgcaacctgaacacctactacgatgagttcgtcatgcgctacggcaacctgaacgccaagcacaacgcaaagttcatcctgatggacgcttcggggcgcaacatgctctcgttggagcgcggcgaggacgggcagtttgtcaaggcggacatcttcgaccgtcccgtttccttttcgcaggaaacattggtcgaagtggaatcgcccgaagaagccctgtccgcctcgctcaacctgtacggcggcgtgaacctgccctacatggaatccctctgcgacctgccgcaagcggagatgctggaagccctgaaagggcgggtgttctacaacccgttggcggagggctacgagattgccgaccgcttcatcgccgggaacgtggtgcagaaagtcgccgacgtggagggctggattagggaacacgagggacacgcaatgctgccgcaggcgcaggagtcattggcggctttgcgcgagaatgtgcccgaacaaatccccttcgaggacttggacttcaacttcggggagcgttggatacccacgggcgtgtatgccgcctacatgagccgcctgttcgacacggacgtgcggataacctactcggaaagccttgacgagtattccgtgaactgtgcctgcaagacgatgaaaatcacagacgagtttctggtaaagggctattaccgcaactacgacggcatgaacctgctgaaacacgcgctgcacaacacctgcccggacatgatgaaaagcatcggcaaggacgaaaacgggaacgacatcaaggtgcgcgacagcgagggcatccagctcgccaacgcgaagattgacgaaatccgaaacggcttcaccgaatggctggaagaacagtcgccggagttcaagaaacgcctgacagatatgtacaacggcaagttcaactgcttcgtgcgcccgaagtacgacggctcgcaccagaagttcccgggcttggacctgaaaggcttgggcataaaggacttgtacccctcgcagaaggattgcgtatggatggtgaaacagaacggcggcggcataggcgaccaggaagttggcggcggcaagacgctgataatgtgcgtcgcctcctacgagatgaagcgtctgggcttggcgcacaagccgatgattatcgggttgaaagccaacgtgagggagattgccgagacctaccgcaaggcttaccccaacgcccgcatcctctacgcctcggagaaggacttttccgccgccaaccgggtgcgcttcttcaacgacatcaagaacaacgattgggattgcgtcatcatgtcgcacgaccagttcggaaagatcccgcagtcgccggagttgcagcagcgcatcttgcaggcggaactggacacggtggaggaaaaccttgaggtattgcgtagtcagggcaaggacgtgtcacgcgccatgctgcggggcttggagaaacgcaagttcaacctgcaagccaaattggaaaaggtggaacacgccatcaagacgagggcggacgacgtggcggacttcaagcagatgggcatcgaccacctctttgtcgatgagagccaccaattcaagaacctgacgttcaacacgcgccacgaccgagtggcggggctgggcaactccgaggggagccagaaggcgctgaacctgctgttcgccatccgcaccatacaggaacggacgggcagggatttgggagccacgttcctctccggcacgaccatatccaatagcctcacggagttatatctgctgttcaagtacctgcgcccgaaggcgttggagaagcaggacatccgctgtttcgacgcatgggcggcgatattcgctaagaagacgaccgactttgagttcaacgtaacgaacagcatcgtgcagaaggaacgtttccgctactttattaaagtacccgaactggcggcgttctacaacgagataaccgactaccgcacggcggaggacattggcgtggaacgtccgaagaagaacgagatactgcaccacattccgcccacgcccgaccaagaggtgtttatcggaaagctgatgcagttcgccaagtccggcgatgcgactatcttaggcaggccgccgctgtcggaaacagaggaaaaggcgaagatgctcatcgccacggactatgcccggaagatggcattggacatgcgcatgattgacccgaattacgaagaccaccccgacaacaaggcgagccattgcgccaagatgatagcggaatactatcataaatacgatgcgcagaggggtacgcagttcgtgttcagcgacctcggtacattccagccgggcggcggatggagcgtctataccgaaatcaagcgcaagctggtggaggactacggcatacccgcccatgaaatccgcttcattcaggagtgcaagaccgagaaggcaaggaaggcggtcatcgaggcgatgaacgaggggcaggtgcgtgtgctgttcggatcgacgagtatgctcggcacgggtgtgaatgcccagcgcagggcggtcgccatccatcacctcgacacgccgtggcggccgtccgacctcgcccagcgtgacggacgggcggtcaggaaaggcaacgagattgccaagctgtacgcggacaacaaggtggacgtcatcatctatgccgtggagaagtcgctggactcgtacaagttcaacttgttgcactgcaagcagacgttcatatcgcagttgaagtccggcgcgatgggcgcacgaaccatcgacgagggggcgatggacgagaagtcgggcatgaacttctcagaatacatggcgatactgtcgggcaacacggacttgctggacaaggcgaagctcgaaaagaaaatcgcctcgctggagggtgagcgcaagtcgttcaacaggggcaagcgcgattctgaactgaagctggaaagcaagacaaccgctctgcgcaacaaccaagccattatcgccgccatgacggaggattgggagaagttcaccgctgccgcacagatcgacaaggacggaaaccggctcaacctgataaagattgacgggctggacaccaccgatgaaaaggccatcggaaagcggttgcaggatatagccaagaacgccacgacaggcggagtaccccagcgtatcggtgaattgtacggcttccccatcaaggtggtgagcgagcggacgctcagcgaggggttggagttcatcgacaaccgtttccatgtcgagggtaactacaagtacacctacaacaacgggcatttggcgatggcggacacccatgccgccgccttgaacttcctcaatgcgttggagcgtatcccggcgattatcaagcagtacgaggaaaagaacgaggtgctggagcgtgagataccgcagttgcaggagatagcgggcaagacgtggaagaaggaggaggaactgaaacaactgaaatccgaactttccgctcttgaccgcaagatacagttggaactggctcctaaacaagagccagtactggaagaagacggaaagggaaaagaatcccagaaagaaagtctccatgccggggtatctcatgaaatcgtcccgactccgccatcagacaggcacacttggcatatccgtccggaaatgcaaacggaggcacctttaccgcaggtaaagaaagtgaggatttgaggcgcttggataaaaacagttaaggggcatacgggaggacaaccgtatgtccccggctcacttatattttatcagcaaaaaaaacgattattatggcaacaataaaaatcaagttcaggtcctcttcggtcgcaggcaaagagggcacgttatgttatcaagtgatacacgggcggcagacccgcctgattagtacggggtataaattgcacctttatgaatgggacaaggaagcgggcaaaatccgcagcgtgaaaggcaatccggaccgggaacgctatctggaagccttgcgtttccgtatggaggaagaccagaaacggttgaacggcattatccggaagctggaacagtcagggaaactttcttccgagcagatagtccttgcctatcacagtccggaaggacatgacgactgtttctttgtctatgcccggaaagtcatcgaccagaccaaacgcatggggaaagagcggacatccgaagtctatgccagttcactcaacagtttcatccgtttccggggcgaagcgggagatgtacctttggatgcgatggattccgtcatgatgatggaatacgaggcttacctgaagcagaacgggaaatgcccgaatacggtatctttttacttgcgcaatctgcgtaccttatataatagggcatcggaggaaggattggtggaaaaccgcagtccgttccgccatgtccatacgggagttgagaagacggtcaaaaggggcgtatcctcagaaatcatcggacggatcaagaatctggatttggaattatatccggccttggctttcgcccggaacctgttcctgctctgcttttatcttcgcggcatgtctttcgtggacttggctttcttgaaaaagaaagatttgcaaaacggcgtgcttgtctatcggcggcacaagaccgaccaacagctttgcatcaaatgggagcagcccatgcaggaaattgtccggaaatacacaaatccggattctccttaccttcttcccatcatcaaggtgccgggagaaaaggaaagacggcaatacctgaatgcctcgcatgtgatgaacaagcggttgcaaaagattggccggatggttgaatgtcccatcaagctcacgttttatgtcgcaaggcatgggtgggccagcatcgccaagagtcagaatgtgcccgtgcctgtcatcagcgaggcgttagggcatgattcggaagatacgacccgcatctatttggccctactggattcttcggtggtggacaaagccaacagcaaggtcatccggtctattggcagataagaatgattgggtacccccaaacacattttgtaagttgagagattccccttgaacctttcccgttcagggggatttttgttggacaaagtggtaaatctctctttaagagatgtttcgcacgccgcaaaattacaaaaaatactgcaatccacacaggatgaatcctgaaaattacgttttgggcgaaccttcccacaggatttgttcgacaaaagaagaagaattgtttgacaaataaaagtgtatgaattaacaaactgtttattttcaaataaatagcaggttggatacatctcttaaagagagatgtaccgattcaaggcctgagagcgcgatgtacattctgtagtggtagcctcattaaaggtacagctatcctttgtatataagcggattagggggggaataaaatgcgaatcgacaagaaaaccgttgggaaaaaggcttggcggtagaaagtggatttgttcgacaaatcggtgtatctctccgtaagagatgtatttcgcatgcaaagttacacacaattgttgggaaaacggtgataaataccaaaaaagttaagaaatgaatagtttccaatacgtccttaaaaaggatttgtcgaacagttgtttgacaaattgtaattattacattttatacttcattggatatcacctaattatctccaattgctaaacatgatacatctcttacggagagatgtaccgataatgtacatgatttcgagtctaccaaagtacgattgaggtcatgccgaaataagataatgatagcatatataatgctggggaatttccccgaacttttggataataccgttgtaactacatgtgtttcaatatataataaacacttggaggagtcggaaatgtatcccttcaccaactaaggcgtaaggctatccatttattatcatggacgaaatactacctatagaggataaactgcactggtatgccatgcgtgacctcaaacgcagacatgccaaattgcccgcctacaagatgttcgagaacttgaaggtgcagtgtttcactcctatggtgcatcgtttggtcgtagttggtggcaagcgggtggatcaggaagtgcctttcatgcaggacttgcttttcgtgaaagacacgagggagcatcttgatgccattgtggagagtacccccaagcttcaataccgttacaagctcggtgtacagcacactcctatcatcgtccctgtcgcagatatggaacgtttcatcaaggcggtagaagccagtgataatcctaagttctattcccctgacgaggtgacaccggagatgagaaaccggaaaatccgcatcatcggcgggcagttggacggatatacgggcacattggtgaccacacgtggttcgaagacaaaaaggctgctggtggaactgcccaccttgttggctgcctccatagaagtagaagcggagtatattcagcttattccatgaggatatgaaccgattgtaaatttttccctaacaaacaggaaaaatcaatcccccttgcgaccgaaaactaatgctattataaattgatttaatcacaatttcaatgaacaggttcggcatagagcttggcaagttgatggagaatcatctgtcagacatacttttcagtgagcgttccaatagagagcatattcatctgtaccgtgttgataattattgggtggcattcgaacgttctgcttttcacctttgtcacatctatacgaaatcggttattaatgcgatgaaagtgtttcgtgtgcccctccctattgttgtgacaagtgtagaggacagggaaatgccatttgccgtaggtgacatggagtgtatgaaaagaacatttgtagaaaggatatacaagacaggaaagccagttgacggcaaatcattcaatgaatggcactaccaaaacaccatagtatttcaagacacaggctatagaaggtcttaaacaaagaaaaatcaggaatatgagtataaataaagtattttacatcttgctcattgtcgcaagtacagtgacactgggctcgtgcggttcttccaaggaagtagtttatttccaggatttgagacccggggaaacagaaatcaagttgcctgaagtgaaagccattacagtccgaccggaggataagatttccattatcgtcaacagccgtgacccccagttgacggacttgttcaacctgccttatgtgtccaggcaattgggtcagtctttaaggacaaatggcgtgacggcttcaagcaatcaaggagtatccgcttataccgtagatgccaacggtaagatagattttcctgtacttggcaagatacacgtggccggaatgaagcgggaagaaatcgccgaatgtatcaagaacgaattgataaaggagaatttggtgaaagaccctgtcgtgaccgtggaatttgccaatctctgcatatccgtgttgggcgaggtgaacagtccgggacgtttcagcattgaccgggacaggctgaccatactcgatgcactcagcatggcaggcgacctgaccatctacggaaaccgttccaaggtgatggtgttacggcaagaaggggatgtgcaacgggtgtacggactgaacctcacttccggcgaacacatctattcttcacccgcctattatctgcaacagaatgacgtggtgtatgtggaacccaatgaagtgaaagcccgtcaatctaccgtcaacggcaacaacgtgcgttccacctcgttctggatttcgctggcatcgttgctgacttctgtggccatcctcatttttaattaatcacgtccaatctaaatattgtatatcgtggcaactcaaaacaatatatccaaacctaaacaggcggatgactttatccgtatacaagatttgttctacctctgtctcaacaagtggtattggttcgtcatatcgttggctgttaccgtcggagtggctgtcgtctatcttttgaccaccccgccggtatatacccgttcagcatcgctccttatcaaagaggattccaaagggaactcattgggtgatgcggctggtctgatgggagacttcgacctcttccagaccaacaccaacgtaaacaatgaaatacaatcgttgcagtctcctgcggtaatgcttgatgtggtgaaacgccttcatttggacatcagttatcacacggacggagggttttacaagaaagtcttgtatggtcgagattgcccctacacggtagactttaacgaattgcaagacaacgagagcgtggcttttaccattaaccccggtcttgatggccaagtacttctgacggatttttctcgtaatggtgaagatgtggcaggaaagataacggctgtgttgaatgacacagttgacgcccctatcggaaaacttgttgtaaaggttgcgaacgattccgccacccatgattcacctgtttatgtctcacgcagaggataccaagatgccacaggcgactatgcttccaacttgtcagttacgttgagtgatgagaaatccactgtcatcaatctgtcattcaaagacgtgtgcatccaacgggcggaggatgtgctgaatacggtgatagccgtttacaatgagaactggataaaggacaagaatcaaatcgcagttagtacctcggctttcattagtgaccgtctcggtgtgattgagcaggaacttggcaatgtggatgaaaacatctcctcttacaagagcgaacaccttctgcccgatgtacaggccgctgccagcatgtatatggaacagagcagcgagaccaatgcgcaaattctggcattgaacacgcagctttccatggcacggtatatccgcaattacctcaccaattccaccagcaagaaccagctgcttccggccaactcgggcattgaaagccctggcatcgagcaacaaatcctggctatcctgcgggatattaagaaagatattgacaacggggaacagctgggagaagctgtgaccgccgctatgttccaagccatgcgggacgcactggcggaacagaaacaaaaaccgctttccattgacgatgtaacggcgatgatagctggacagatcggacagcttgcaccgatggacgaggaaaccgccgacctgtttcagcggttagtaaagaaaatgattgaacaggcagagaaataaatgtaggagaatattagaaaatgggaaaaagcaactcgtactatatgcagcttcatgtagaagcactgtttacaatgaatgaaaagaacgaacttatgactataagggaaccatgggactccacttcacagccggctccccgcttctatttgacaagaccactttacgaaaaaccacatgcttattttcgcgctgacgtaccgaaagaattaagagaaaaactacaatcaattaccaacagagagccagtactgatgctgccgaatgaatcacctatttatgataaagaatatcggcaactattaggagaaagtaagatttcagaagatgcttgtttttggcttcctgaacagccaaagttaaaagcctgcttactcactaaagacaacattgagcctcagatgagccactattttccctggctacctgaagagttgctggatgttcccttttgcgctgcttatttggaagattctcaagtcgtatctatttgtcgtagtgttcggattattcttgaggcagaggaagcgggaattgaaacggctgaactttacagaagaaaagggtatgcattccacacacttgcagaatgggcagaagcagttagacgaaatggtagtattcctttgtatagtgcgtccacttctaacttagcctctttaggtttagcaaaaaaggcaggcggcattttctttggtaacggtttttgcgtttgctgatttatggttttggggtataataaactgtttgaagaagaaaagaagcggctaaaatagattgcggagaagttggacttgccgaaaaatccaaacccacagcggggacggaaaaagaaatagagaacagcaaatcgaaataggaggagtgaaaatgaaccaaggaagaattattgtgattacaggttcgccggggacaggaaaaactacaacggcatctgctgttgcaaaagaatcagatttggaaaagtctgtgcatatgcacacagatgacttttatcattatttgagtaaaggggcaataccaccgcatttgccagaatcaaatgagcaaaatttgattgtcattgaagcgtttttagaagctgcgaagcgatatgctcgtggtggatatgatgtaattgtagatggcattgtaggaccgtggtttttagagccgtggctcaacattgttcaagagcattatgaagtacactatatcgttttaagggcaagtaaagaagaaactatgaagcgagctatcgaacgctcaaagttagacagagaaacaaatattgaattagttgaaacaatgtggaatcaattttccaatttaggaatctatgaattaaatgttatagatacaactacgcattcaatcaaagatactgtttcagcagtaaaagaaaaaatagtaagtagggcagcgttgttgtcttagatttttttgcttttttgtggtatattatcctcagacagagctaaaggagagagcggaacatgaaaagcgattattcaaaagaaagcatcacagagtttttaagccgaaagtacggtgaggatataaggctttttccgataaaagaagggcaggagtcacaggcgtattggttttcgcgtggcggcagagaatatgtcgtgcgcataaattcaaatatggaaggcttcaaaaaagacaaatacgcctatgagcacttccgctcggatagagttcctattccagaggttgttgaaacaggcaactttgacggcacgcactacttctgcatcagcgtaaaagcggacgggattacatatgaggactccgatgaagaaacggttgtgcgactgctcggcgatattacggatgtaaccgaagcaatatcgcgaaccgatatatcaggcacttccggctgcggcgtgtttgacagcgatacgggaaacgctccgttttacagctggagagaatatcttgcggaggtattcgagagagactggacggcggtaagcaggagctatgttaacctctcactcatcgacgagcttctcgcggcatatcgtgagcttatatcttattgcccggaagaaagagcgctgttccacggggatttcggctcgaataatgttatcgtaggcaaaaaatcgaggataagtggcgttatagactgggactgcgcggcttacggggactttctttacgacatcgcgaccgcgtatttttggcggacatggctcatgtgcatggaaaaaactgcggcgtattgggagagaaaatactctcacctgccgagatataccgagcgaattttatgctatgagctgcggatagggatgacggaaatatacgaaaacgctgtcgaaaacgatactgagacaacagagtggcttcaaaacaggtgccgcgagattttgagagaatacagacaaagaaaggcatgataaaatgagaatactgttcacaggctttgacccgttcgggggagagaaaatcaatcctgcgggagaagccgtaaaaatgatgaaaaacgaaatacaaggcgcggaaattttaaagctcgaagtgccgacggtgtttggaaaggcaggagaggttcttaaaaaagcggtggagcaatacagacccgacgcggtggtgtgcgtaggtcaagccggagggagagccgccattactcccgagatgatagccgtgaacataatggacgcgcgcattcccgacaacgccggaaacaagccgtgccacgagcttataataaaagagggaagagaagcgtatttttcctcacttccggtgaaggatatcgagaaaaatctaaatgataacggaattccgtcgtcggtatcgtatggagcggacaacgagtaaaagagtgaccgccgagataacccattgctcggcggtgttcctttccaagttaattgcgtgatatagattgaaaagtggatagatttatgatacagtgaatagatttatgatataatgagttatcaacaaatcggaatttgatgaggtgtaattatggtaagaattgcaacagtaaatgatgcagagcaattaaacatcttaaatgatgaatttaatggtgagagcgaaacaagcatagacaatattagaaattcccttatgaataataaacaggaagttgttatcgttgctgatgaagatgatatgttagttggatttgtttgtgttcagcttaaaaaatcgttctgctatgatgaatatatgcctgaaattacagaagtgtatgttaaaccagcatacagaaaaagaggcttagcgagtgagatgattacttttgcagaggcttattgtagtaagaattatccacttcaccaatatgaacttctaacaggacaagaaaatcttgttgcacaaactgtatataataaacttggatatgtagatgataatgaacttcatttatcaaaacgagttaagagatagtcaaatcggaatttgtggaggtaaaatatagataaatcaaggtagaattattgtaatcacaggtgcgccggggacaggaaaaactacaacggcatctgctgttgcaaaagaatcagatttggaaaagtctgtgcatatgcacacagatgacttttatcattatttgagtaaaggggcaataccaccgcatttaccagaatcaaatgagcaaaatttgattgtcattgaagcgtttttagaagctgcgaagcgatatgctcgtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatttgattgtcattgaagcgtttttagaagctgcgaagcgatatgctcgtgggggatatgatgtaattgttgacggtattatcggaccgtggtttttaaagccgtggcaaagtcttgttcgggaacattatgaggtgcattatattattttaagggcaagtaaggaagaaaccttgaagcgagctgttgaacgctcaaagttagaccgaaagacaaatatcgaattggtagaaaccatgtgggagcaattttgcaatctgggaatatatgaatcgaatgttatagatacgaccacttattccattcaagaaactgtttccgcagtacaagaaaaaatcgcaagtagggcagcgttgttgtcttagattgttttggtgcaattcccatttatcgagcagatgaagttggggagccgcctggaggcggcggtgccgaaggataaaataggagatgttaaggttatgaataatgaatacgataatgagaagttttttgaagaatatgcaaagatgtcccgcagtaaagaggggttaaaagctgctggtgaatggcatcaattaaaacctttgtttccttcgttagaaggaaaatctgttcttgacttggggtgcggatatggctggcactgcaagttcgcagaagaacaaggagctacaaaaatattagggatcgatttaagtaagaaaatgattgaggaagcccaaaagcgcaattcaggaaatcaaattgaatatcgtattagcggattagaggaatacgactatccagaaaatgaatgggattgtgttatatctaatttagctcttcactatatagaggacatagtggaaatatttcaaaaagtgtataggacattaaaaccaggtggaatttttctttttaatatcgaacaccctgtttttaccgcaggagttgggcaagattggatttatacagatgatgggaaaccgcaatattgggcgattgataattactttataacaggagaacgaaatacacattttttaggatgtgatgtagtaaaacaacatcacacacttacacagattataatgggattgctgaacaatgggtttgagcttaaagttgtagaggaagcagactttttagaagaatttgatccacgctataacgaagaaggtgtatcagaacttgatgaacaatttgagcggttgccagacggacacgaagcaaaacgcagttactatttaggcttccgacaagcacaaagtgaagcaagaccaaacattgttattagtctattgaagttaaattagatgctaaaaatttgtaattaagaaggagtgattacatgaacaaaaatataaaatattctcaaaactttttaacgagtgaaaaagtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaactgaatactcgtgtcactttaattcaccaagatattctacagtttcaattccctaacaaacagaggtataaaattgttgggagtattccttaccatttaagcacacaaattattaaaaaagtggtttttgaaagccatgcgtctgacatctatctgattgttgcagaaggattctacaagggtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcagtttcatcaagcaatgaaacacgccaaagtaaacaatttaagtaccgttacttatgagcaagtattgtctatttttaatagttatctattatttaacgggaggaaataattctatgagtcgcttttgtaaatttggaaagttacacgttactaaagggaatgtagataaattattaggtatactactgacagcttccaaggagctaaagaggtccctagcgcctacggggaatttgtatcgataaggggtacaaattcccactaagcgctcgggaccccttgtaggaaaatgtcctaagtgtggcaacaatattgtattaaaaaaatcgttttatggttgttcaaattatcctgaatgtaccttcactttagctgaacattttagaaagaaaaaactcaccaaaacaaatgtaaaagaattactagagggaaaagaaaccctggtaaaaggaatcaaaacgaaagatagaaagtcctacaatgccgttgtaaaaatcggagaaaagggatatattgattttatctatgtatgagaacgtattttttgaaatgcttgagcgaatcattcaattagaaaacgaaaaagaatagaatcacaaatcacaagtgattaatcacaaatcacttgtgatttgtgattgttgatgataaaataagagtaagaagaaatagaaagaagtgagtggttgtgggaaatttaggcgcacaaaaagcaaaacgaaatgatacaccaatcagtgcaaaaaaagatattatgggggataagacggttcgtgttcgtgctgacttgcaccatattataaaaatcgaaacagcaaagaatggcggaaacgtaaaagaagttatggataaagccttagaagaatatattcggaaatatttacctgacaaactttaaaaggagtgaaaatgaaatggcagttacttatgaaaaaacatttgaaatagagatcattaacgaattatcggcaagcgtttataatcgagtattaaactatgttttgaatcatgaattaaataaaaatgactctcaattattggaagtcaatttattaaaccaattaaagcttgcaaaacgtgtaaatctttttgattattctttagaagaattacaagccgttcatgagtattggcggtcaatgaatcgctattcaaaacaagttttgaataaagagaaagtggcttaatatggcaaatatagtcaattttactgacaaacaatttgaaaatcgcttaaatgataatttagaagaattggttcaaggaaaaaaagcggttgaatcgccaaccgcttttttacttggtgggcaaccagggtcagggaaaacgagtttgcgatcagcaattcttgaagaaacacaagggaatgttattgtcattgataaagaggggttaaaagctgctggtgaatggcatcaattaaaacctttgtttccttcgttagaaggaaaatctgttcttgacttggggtgcggatatggctggcactgcaagttcgcagaagaacaaggagctacaaaaatattagggatcgatttaagtaagaaaatgattgaggaagcccaaaagcgcaattcaggaaatcaaattgaatatcgtattagcggattagaggaatatgactatccagaaaatgaatgggattgtgttatatctaatttagctctgcactatatagaggacatagtggaaatatttcaaaaagtgtataggacattaaaaccaggtggaatttttctttttaatatcgaacaccctgtttttaccgcaggagttgggcaggattggatttatacagatgatgggaaaccgcaatattgggcgattgataattactttataacaggagaacgaaatacacattttttaggatgtgatgtagtaaaacaacatcacacacttacacagattataatgggattgctgaacaatgggtttgagcttaaagttgtagaggaagcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattataatgggattgctgaacaatgggtttgagcttaaagttgtagaggaagcagaaccgcctaaagagatgatggatattccgggtatggaagatgaacttcgccgcccgatgatgttacttgtaaaggcgatagcgaaaaaataatatctctattaggaaaactgatataccccaatttagagaatggcatagtaattcctagtgataaagagaaaatgattgcactggcaaataaatacattgaaaaagaaaatgtagatgcactcattctcgcctgtacggagctgccacttgccataaagcccgaagatgttaatgtgccaatcgtgaatacaacccaagtacatatcaatgcaatttaccaatatgcaattcgataaaaatagcaaagccagccgagccagtcaacggtcaagatgaacggcgcatttcatgcgccgccgttgacagccccgcccgtctttgctaaagggtaatcaaggcgggaaagccctaaaatggtttccccgcccatttcaattttgggaaaagaaatgctccaaaatcaaaaagagagcggtcaagcactttgaggattggccgccttgttcacccattcagcggaacggcgggcggcggtcaaggccgggtgcaaacccgttcatttcagccttgacggttgcctgctgtcctgctacttttccgggagtgtggccacacttcgggacactttgtccacaagtcggagcgaaggacgagggacgggggctttcatatacctgccgccgttctctgaaaacaggccgattttttgctcattcccattcgcaaaaattcagcctgttttcctgccggagcaaacggggtgcaagaagcaccgcaccccgtttcctctgtcagccacgccagcaggtataacacactacactttgcaagcaaagtcgtgtgccaaagggggcacccctttggaaaccctagacaacaaaacaggcggtatgctgccctctccgggagcataccgccgtttgttgtcagcagcccgtttcacggtctgcgtgtagttccttgtaaactgacctaaggtggaagctaaaacaaagttttatcatgaaggattatatttggactaatgaaagtgtgaataaatgattgggaaaaataaacctttcacctcttttctggtgaaagactgaaaggcactttgtgcgagtgtcgtttcaatgtgagccatcttagagtaaaatcaggatggctcacattgggttaaaaggatgaagagaaacttgcgtttcgtagaaaatgtggtaaaaggtatcagatgaaagatgaccgggatatgaactatgacatcaattaacaataaaacaattacgagcgtatatgaaaaaatgaaagcttacgagagaataagcaagaaactgttcattttgctattcatgctggtcttttatgggtattcatccataattgcacagccgtccatacccgctggtcaggtagatatatttgtaggggcggatttcaactaccgggatttgtttcacaatgggaaaatatatgagattttgctgaatctgactcccggtgtgaaatggaacatgggcaaggggtggcaggcggcagcacaggcattagtgccggtgtataacgactatggcgaccgatacaagaaagtacggttgaacatggcggtgttatctaaagaggcgcattggcgatcccggtggttcctgaaagcaagcggcggcttgttcggcagggagcggtatggattggacttgaaagggatgtatgtcgtaaaccgctggttggcattggaagtgcaggctggattaaccggctattgttcaatggcagtggactgggaagcaagtacccccaaacggattaccgccttgctgggcaccgatgtctatctgaacaaatggaatacgcagttccgcgcaaggggcggacgtttcctctatgaagattatggagccatagttgaagccatgcggcatttcaaccactgtacggtcggattgtacggcgagtatagcaacgagggcggcaagaatgccggttttaaggtggtgatgatgataccgccttacaagcggaaacggcgcactgtcaatttccgtccggcttctaatttccgcctgacatacagtatggaaggtgacgcctatgccaacaaaatgtacacgaccgacccggaggagaacgaacgcgagggctggtttgaccgcaatgccctgcaatggggcagcaacaccatgaagccggacttctcggaaaaggaaggagggcggaaatgagaagattattgattggcctccttgtcgtgatgggctgcattccgatattgagggcgcaagagtattcgggcgttaccggcatgatccacgtgcccacggcggaaatggcgacagagggagaagcccgtatcggtttcttcttcctgaatcaggaatttcttcctgacacctaccagtatgaaggagagaaattcaacacgaccaaccattttctggccatcacccccttcccttggatagaaatagcgtatgtctgtaccatactgaaggggattgacaacgatggccatgtcggacataataagaaagaccggtactttcacctgaaagtgcgtccgctgaaagaaggcaaatggtggcctgcaattgccataggcacccaggatcccggcagcaaggtgaacgagtcctatgccgaaggcaaatatccggtcaacgactacttccagaattattatatagccgccagcaaacacgtcatgtacaggcggaatgaatttggttttcatttgacctaccgctattttacatcggatttcaatgccaaatggcggggcatagccgccggtatcacctatcgcccgtcctttgccagaaaccttcgggcaacgatagaatataccggtgacgatatcaacatcggcgcagactgtttgttgtggaaacacctctttttgcaggcaaccttgcagaatgggaaacatttcacaggtggcctgtgtttcaagttaaacctgttgggcaagacccaccctgattgaagacacaaacaatacggatataactactagaatacagaatttcaaaataacctaatttaatcgtttaattatttttagaaatggaaaatcttagaaatctatcaagatggggaatgttcgcattccttagtgtggctttgtgcaccagtttcgtagggtgcagtgacgatgatccggattacagcaacgtgacgccgcccacggtgtccgtatcgcacagtatcagcgggcgtgtcaccggcatggacggcaacggcctttcggctaccgtgagcatgaacggcgaatcgacacagaccggcgcagatggcacgttcacttttgacgatgtggatgccggaagttataccctgacggcttccgctccggggaaacagtccaaggaaacaaccgtcaccgttgcagaaagcggaagcggagccaatgtcgtatggaacgtgtcattgcccaatgaaggcacgaccattgaagtagccgccaacggcgatacggaggccaacgtgacttcagagaccatcgaaggcaatgacgagggcgcggtcacagtggctgtcaccgtacccgagacggcggaattgcctgcgggaagttccatcgtggttaccccgctttacacgctggatgaagccgaagccaatacccgtgccacttcccgtgctgccgaaagcgtcatgctgattggtacaagcgtggcttgcaccgatgcgaacgccacgctttcaagtcccatcgaattggcttacgatgtggatgcggaagtggcgcaatccatcacggcacagaaatacgtgaacgggcaatgggtggatgcagaatatactgtagaaggcggacaagtaatcgtgtttgccgaccagttcacttcctatacgttgctctttggagcggatgtgacttcttcctccacaagcacgccgttggcctttgaacaagacctgtgggacaacctgtatggatcgggtgacatgaccgttggttcggcctcgttcacttatcacatcggaacggaaatcacttcgtccgggaccagtcggataaccgcttacctgattgagattctggcccgcattgccggcgcaggtgtcactacggctacgggaacttaccccatcaatgtgaccttgcccgtcggtacggccttgcacgtggcaggtactcaacaagtgaccactttgaccgtctccgcattgaaccgttccgtcagtggaagacaatacggtgatgtggcagtcgtgacaacctcttacaacagaaaccataatggagggacgagtgacaattgattgttgtttctcaccttgtagacagatatattaaaaagcactgtctgcaattacctgcaagtagttataatagccgcccggaatcaggacggctatttttgtagctgtatccgaagcaggaaagaaatcgtaagttttcgggaaccacaggtacaacctttgcatgtgaaatggcgactgcaactatgaacccaaatgttgtagtcgccattgttttgttgtacctgtatgcaagtagttgcattgtctatcagactctctgtgcattttgcattgtctgcactcttgccggatgttgtaatatccgttcgttcggatgcctgcgttacgcttgcataatcccaatgactattttacaatcaaacacccgtcatggtgcggctcaatttgttttgaatcgttctaaaaaaataattattcataaactctgaaccggtcgcatggattgtggttgataatttctatttttgcccataaacgaggtagcacattctgatgagagaatgcactacggataatatgactagcaatgaaagtatccttgacacaaaagatatatgccgggaacttcctgttgctggccgccatagtcggaatggtggttatcctctttcgtgagcgtagccggatgcgggagatagatttcgaagtgcatgacctgcaatcggtacggaatgacatccatgccgcacaccttcacatcaccgagctttccctgctgggcgagagcctgatcagccaagaaaatgcagatacggcaaactatcgccagaaacggctgtccacagacagcctgctgctggccttgaagccccggtgcaggcagcatgtacgtcccgaacagatagacacgctccggcacctgcttgccgacaaggaaatgcacttgttccgtgtcgtggaagccatcgggatacaggatgctgctgacagtctgcttgtccaccatctgcccaaagtggcggaacgtgccacccgcatacgcaccgtgaggaaaagaagggacaatatactgggagcgttgggcgccaagaaaaccgtccgggttttgccttccgccggagaactgcacgcattcagtgacagcctgattgccatgcagcaggaagggacggaggatatggaaaccagtgccgacagcctgtacgcccgcaatctggcattgaacgcccggctgaaccacctcatcaagaatctggacaggcaagtgcaggaagccttctttcagcgtgagcataagataatggaagcgcaaagccgttccacgctcctgctcacctctaccttgtccaccgccatcctccttttaatcctgttccacatcgccatccaccgggaaatccgccgcaatcatggcgaaaaaaagaaacgcgaagaacttatcggcgaattgcaggcgagcaatgagaagaaccggcaattgctgcaattccgtcacaacctgatgcagactgtcagccatgaaatgcgcacggccctgacggcgataagcggcaatgcagaactcctgctccgggatgaagccctggaagaccgggtacgccacatattaaccgtgcgtgaatctgccagccgcatggcttccatgaccaccgagctgctggaatttttcaggctggagatccataaagaaaagctgcatatccgtccattccgctccgagtcaatagcaactgtgttggaaacggagttcgcccctttggctgaagccaaaggaatcgaattcgtgactgacaaccagacgacagaagtgctgggaggcgataaggagcgcatattgcgcatcggaagcaacctgctctccaatgcggtcaagtttacccgcagcggtcgcattacactctgcacggactataaggacggcaacttcatcctgtacgtgcaggataccgggacgggcatcccggaagaaaagcaggaacagattttcgcccccttcgaacgtctgggcaatgctgtgactcaggacggcttcgggctgggccttgccattgtgaccaatctcgtacagctgatgcagggttctgcttccgtacagagcaaacctggcataggaagccgcttcaccgttgtcctgccgctgccgaaagccgaagaagtaccggaagaagagaagtcaatggatgtccgtccttcactggccggatgttccgtgctggccatagacaacgacccggtgacgctccgcctgatgcgcgagatgtaccttcaatgtggcgtttcatgcgacaactgccttacgttggccgagctgaccgacaggatacggagcaaggattatgacctgttgataacagacttgagaatgccggaagcgaacggctacgagattctggaactgctgcgcatgtccgacatcggcaattcccgtgaacttcccatcgtggcagctactgcggccggctatgtatcggaggaggaactgaaagaagccggattttccggattgcttcccaagccgttttccatagacgaactgatggaggcgacacggcactgcatccgtgaaagagggaaccggcagccggacttctccgccctgttggctttcggcgacaagcggaaaacattggagcagctgattgccgaaacggagaaagagatagaggaagtccggaaggcatccgaaaggaaagacttgacagccttgaacagctgggtacaccatttgaggagctcatggatggtgatacggacggaacgccccttgcagaagttgcacgaagccatccacaaggaaccgtactcggacgaagaagtcgcctatgcagcccgtgccgtgttggaacaaggagaaaccatcatagaagccgccagaaaggagatgaagaaatgggaaagataatcgtagtggaagacaaccttgtgtacagcaggtatgtctgcaattttttggaagaaaacggataccggacagtcagtacctccgattgcaccggtgcccggaaactgttttcaatgctggaagatgacgacatcgtgcttgccgacctccggttgcctgacggtgacggcatcctgttgcttgaagaactgcgccgcgaggggaagcacaatccctacgtcatcatgacggattatgcggaagtgcctaccgccgtgcgttccatgaaatccggagcggaagactatatccccaagaaactgctgaccagccagcttcccgccatgctccaagacttgcagaaaaggcagtcattccatgaggaacccctgttcataagggagagcgaagcctaccagaaagtattcggacgtctccacgtcctagccaaagccgacatctgcgtgatggttcggggtgagaacggtacaggaaagaaacatatcgctgaaaagatacatgcccaaagcgaccgtgcggacaaaccgttcgtgacagtggactgcgggctgttatccgaaagtctggccgcttccgccttgtttgggcatgaaaaaggggcttttaccggggcggtcgggcgcaaggaaggctattggtcggaagccgagggaggaacgttgttcctggatgagataggcaaccttcccctcggcgtacagcagatgctgctctgcgccatacaggacaggcgttaccgtcctgtcggcggcacaaaagacaggaaagccaacgtgcgcatcatcaccgcaacgaacgagaatctggaagaagccatatcggaaaggcgtttccgccgggacctgtatttccgattgagtgagtacaccgtgaaagtacccccgctcagggaatgcccggaagacatcctgccgcttgctgaattcttccgggaactttacaaccaagagcatggcagacaggtaaaaggtttcgatgcggaggcgaagaaacggttgctggcccatgactggccgggaaacgtacgggaactgaaacaggcggtccaatccgccgtgctttttgcccaaggggaattggtgacggcggaagaattgaacttggatgagtccggaaagccttccgatcctgacattgccttgaaaggggaatgcatggaaaagaagcggatatgccaggctttggaaaaggccgggcataatcggaaagaggccgccagactgctgggcataagccggagcacgctgtacgagaaaatggacctgtatgggattcagacgaagaggtgacatggcaggggaaaggacgaaacggaatggaaaaaagcggaaagaaagggcggtactgtgtacgaaaaacggacacctgtccggaagtcggacacgggaaggaggctgcctattcttccttaaaacaaattttcgtctgccaagagcttgatttgcaagaaattgcatacaagttcatcaccataacattgtaattggactatcatttgctcctatggatgtatgtgcgcacatttcatccgagtaaaaacaaaaaattaggaacaaatggaacatctcaccttgacggaaaccgagtttttccgtctgataagcaatcccgacagccgcaccgggttacgcacggcctacgatgagtttacacaaagggtcatccaactctgtctcatcccgcccgaaagcggacatccggtacacgccctgagctatgcggaaacggagctgcaataccatgaggccctgcaaggcaggagccatgagagcgaactgaatctgcatgtacacaaggcccttgcctttgtgcgcaagatgctacggttccttgcccgggaataccatccgttgccgccctcccacatgtttaccggcgagaaaaccggcgcccctccttctgatgcccctccgatatgttggacaggcagcatatccgacctagtggaattattgtacgggctcgacaccctgaaatgtatcaacggcggagaaaccggtatccaggaactgatggtccatttctcccgattcttcggcatggagttgaagcccagtcagtgctacaacgcctatgtggatatccgtcgtcggaaaaatgacagccgtacctatttcttcgaccgggcttccgaaaagctgaacgagcgaatcgtgaaagacgatgagcgggaacgggcacgcaagagatgaaagtttttctgtctgattcatgaccgggaacaaggtgtatgggtagaagccccttgctcccggtttctttttcctgttctagcaatgacaatttgcaagaaaatgctccaaaatttcgtatctgtcggtcaaatgattatttttgccctccaaacgattacgcatgaatataaccaatatagacgacatacgcaaactggcctccggcgatgaagggggacggacagaatacaagctgatcaccgggcagttggagcgcggcatggagacactgtgcgccttcctcaacggcgagggcggtacggtactgttcggcgtggctgacaacgggaaaatcaccggtcaggaagtgagcgacaagacgaaacgggaaattgcggaagccatccgcctattcgagccgtttgccacgataacggtctcatacgcaaacattcccgacacggacaaacaggtcattgccttatatgctgaggaacaacgctatatgcgtccgttcacatataaaggcagggcttaccagcggatagaaagcgtgacgtctgtcatgccgcaggacaagtacaaccacctgctgatgcaaaggggcggcaaatacagttgggaggcaatccccaaccccgacctgcaaatcagcgacctcgacgagaatgtcatcatcggtgcggtacgcgccggaatcaactgcggacgcctgccggaaaccaccattcgcgaagaaatacccgccatccttgaaaaattcgacctgttgcatgacgggaagctgaacaatgccgccgccgtactgttcgggcgcaatctgtacgactatccccaatgcctgttgcgaatggcaaggttcagaggcacaagcaaagaggaattcatagacaaccaaagacagcaagggaacatctacgcgctattggacgctgccatgtcgttttttttcaagcacctgtccttgtcgggtaaaatagaggggctgtaccgtgaagaaaagctgagcataccttacaaggcattgagggaatgttgcatcaacgccttttgtcacagagcctaccaccgtccgggcggttcggtgggcatcgccatttatgacgaccgcgtggaaatagagagcagcggcgcgttccctcccgacatgacccttgaaaaactgcttggcggacacagttcagagccgcccaacctcatcatagccaacgtgctttacaaaagcgagttgctggaaagctggggtcgcggcatcagcctgatgatagacgagtgccgccgtgccggcatacccgacccggaattccacacggacgggagttccgtatgggtggtattccgctatgagatggaaacggctggacaagcatccgacaagcatccgacaagtacccgacaagcacccgacaagtacccgacaagcatcgtccggctcattgaactgataggggaacacacttgctcgctgaaagaaatgatgggaatgatggaactgaaggacagggagaatttcttgggcaattaccttaacccgtctatggaagccggattggtggaaccgctctatcctgaccagccgaaacatcccaagcagaaatacaggctcaccgaacaaggaaaggctttgctggaaaggggtgagtaacatggtgaagaagaaaaggaaacacggcggacactactgcaaggtatgcggctgccacaagtccaacgagagcttctcgggcagaggacacgcgctgcacatctgcaaggaatgccagtcgcttccaaaggacgaacaggcggacatgatgcgctgcaacgaggtggaacgcgccgcgttccgcttccccatgaggcggcaggactgggaactgctggaaaaatatgccaagaagtacaaggacagggagtcgggaaaattcgcgcaggagatgctggacatgaaacggggcgtttttgtgccggaagaggacgatgaagaagcggatgaatggaacaacgacatttttcaggtagcggaaaccccgttttcggaattggaggaagacacccgtaccgccatggaggaactactggaggacaacatcaacgagtacatgatacacaaggactatatccccgaagggaaggacttgcaggacatagccgattgggtgttgaaggaaaccaatgacacgttttacttgaaagccgttcccgatgacgcctaccgcaggctggtggatgataccgtccggaagatggtcaaggagtggaaagacgacggcttggagataaagacctacgccgagtcgctcacgatcatggaaacggaacggctcgtcatccgcaaaatcacccgcaaggacacgggcgcgttgctcgccctcatgggcaagtcggaagtcatgtacgcatgggaacacggctttgacaagaaggaggtgcgccaatgggtgaaccgccagttctcccgttaccgcaaggacggctacgggtatttcgcccttgtgttgaaagacgggggcaaacttatcggacaggccgggctgatgaaaagcgtgataaacgggaatgaagcggtggaactcggctacatcctggacaatgcgtattggcacaacggctatgccacggaagccgcccgaagatgcctgcggtacgctttcgagaaactgggcttgcaagaggtctattgcagcatccgtcccgaaaacacgtcctccatccgtgtggcggaagccattgccatgaaaccttgcggcagccataccattatatacaatggaaaagaaatgccccatctgctgtataaaacggagaaaccaatgcagtaattttcatttcaattgtcaatcaacgagaaaaggacaatccttaacccggtctgaacatccagccaagttaaggattttccttttttcgcctatggcgtttttacttgccctgcaagaggtgttgcagttccgggtcggactggatgcgctgcaactcgtcggcgacaatctgccgcacttccgccttgatgcggttgtagttctcctgtatcatttccttcatgcggtcgttgccgtcggcatcggtgaagtccgtgatgacggggatgggcttgtaagcctgttcctcgcgcttcaccttctccacgtccaccacaatctcgcaatgaaagattttctgctcgatgcgctcgttgaagttgtcggccaccgcgcccacgaacatgccctgcgtcagcgtggaaatcttgctcgcgggtatcaggctctccatctgcgtgttgatggaggtggacttgtcctcccggttgatggtgacgctctgccgcttctgcaagattttgccgaaacgctcggaaagcgttttggcggtctcaccaacgacttgacccgaaaagatgtttcccaccgtgttcatcacgaccgccgcttctttgtccccataatcgcgtttcaactgcgaaaagtcctgaaagccgaggcagaccgccaccttgttgcttcgggcagtggcgataagattatccaatcccttgaagtaaatcgtaggcagctcgtcgatgattaccgccgacttcagcttgcccttcttgttaatgagcttgacaattcgggaattgtacagacccaacgccgcgccgtagatgttctgacggtcgggattattgccgacgcagagaatcttaggctcatccgggttgttaatatccaacgtaaactcactgtctgacatgacccaataaagctgtggggaaatcatgcgcgagagcggtatcttcgctgatgcgatttgccccatcaactgctcggctgcacctccctgccaagcgtccataaagggcgaaagatagttttccaactccggatagctggtgagaatagggaaaacatcctcataacgtctgttcagcaactcaatggcgtgtgggaaggtgcaatactttccatcctgataaatccgtaaaaaccagataatactggcaaaaagtataatcggactctccacgaagaagtcgccttgcttttgcacccaagttttgttcaaatttaataaaatggtataggcactttcgtaggcatcggtgatgtcctccatgaaatccgggtgaatgggattgcagcggtggctccggcgcgggtcgtcgaagttaatgacgtagaacttcggcttgaccttgtagccgtcgccgtggttcatcaggtggttgtaagcgatggtggaaaggtcgctgaacttgaagtcatagatgtacatcgagtaagatttttcaatcatctgcttgataaagctgtttaccacggcatacgactttccgctgcccggagtgcccaatacgatggaagcgcggaacgggtttaccacgttgatgtacccgtcgttccacttcttcctgtaatagaagcgcgtaggcaggttcaccgaatactcgttctccatgaggcgcgtctcctgcatgaagctctcgttttccacgttgaacacgtcatccatgaggttggtgcgcaagaggcggctcatccacgtgccggacatcaggaggcagacatagcccgccgccatcgaagcggcatagaaggctacgttggcttccacgggcagcggcagggagagcatccaccagttcaggaagaacagggccagccctgcggcaagcaccgtccaaatcctgccccacgtgattttttcctccttcacgccctttgtacccaagcaagagagagccaatagcaacagcgcaaaaagttttgtgtaaaggatatggtggaacagtccggcggtgcggtcgaaattgaccagcacccggtccacgacaccgatgtcgatgccccacagccttacggcttcatacccgtaccaatagaggtggacgaccaccagaataatgctcacggcgcggagaaagtccatgattttcgccaacgccctcaaatcgtcttcctgttgtgacataaatctgtttctgtttttaagttgaacaatatgtccgcaaggctttccccggacataagcatacctcaagtccgacctgagcctatctcaagtccgaggtgaggctaccaaaggtctgaccttagatagccaaaggtctgacctttgcttggatgccctgcggacggataatttataatcccaaacccttccggcgtttcttccgcttgcgtttgagttcgcgctcgaaggcggcttcttccgcctgtgcgcccgatgcgtcgccgccaagcaagcccaagcccgtggaatggctctcgccgtgttccacataggtatgggcttccgcctgcggttcgtcccgtgtaagggtgaacggcatcggcggcgtgtccgcatacggcaaagtgaagtgctcctgcaaggcgttggcggaaaattccctgcccagccgggagccgttcagcacacagcccgtgcggtggtcgatgaaggtcgccccgtagatgcgccccccgtccgtgtggcggaacaccacatccacgcccttcgctttgagcagggcgacaaattcatccttgcggtacgtcctgtccaatacggcagcgacggtcttgcgcgtcatgtccgccagacgcttgtcgcggatttgggcattgggatactcaaacctgcgcagcacggcttcatagccgacggacttcccgatgcaggatgccttgaagggattgccgaccttgttcccgccatcatcggtggcggaatagaccagtccgtgatactcgcgtccgttcaccatgccacgggcttcctccacagtgacgttgtagagggagagcaaggcgcggtattcgcccattgtccggaacttgtaggtagccatcaccgccttgacggtgttcgacacctgacgcttcacgtctccctgcgaggcatccaccttgcgcaaggaattgtcgttacggtgctgcctgcggtcggcggggtgcagaccgtacttgcgttccagctccgtggtgatgcgcttgctgcggcgatggatgaaatccttgttcaaccgcctgccattctcgtccacattgacggagacgatatgcaggtggtggcggttgatgtcctcatgtttgaaaattagataaggctggtcgccgtagcccagcttctccagatactcccgcgcgagactttccatctccatgtccgtcaggcggtcgtcgggatgcggattaagggagatatggatgaccttgttccgtgtgcggacgttctccggcatgtaccgtttgaaatcctgttcggcacgggcgatgtccacccgtccgctgccatcgtcgaagaccttgttcccggcgagcagcttcccctcgccctcgttcactttcatgccgttgtaagccaacgccccgtacagcgacgtgcctaccgtgatttttgcgaccatctttcctgaaactcccttgaaagttcaacgacctgccgcgtgattgcggccagttccttcgtgcattgctccagcttgtagagcaatgccatcgcctttttctccgagaaatggcagcgcagctccttgaccgtctggttatagttgttccccaccatgcggtactgcgcatggaaagcggacagcttcgtgcagtagtcgagcagcgtcttgtccgtgaccagtacccggaacggctgtccgaagaagtgcgccttcaggaacaccgccctcgcctccacgccggacttgccgtgcatagcgaggaacctgagccattccccgtcgtcgaaacgcaccatcacgcagtgcgacttgcggctttcccgtggatgccgcccccacttgggactgtcagtcccgttctttttcttgttctcgttcatattacaatggatttagtggtgtcacggcataagcgtagcttcggcaaccgcaccgcaggtggaaacaggcttcccgacttcggagaggaagccctccccgtgaggggcaaggtcgtttcgggagtaacccgaaaccctttgagttactcaaaggacaccttgctgtgtctttgaggacacaaaaatccgtggtaaacggattggggatagacctgccattacccatttataaggcatcggtcgcccgatacctttctgctgcccaaaagaaggacggagccggggtctgcggtgcgcgctttcggctttgccctgccgcttgggtgcaaaggtagggtgttttccaagtctgaaatacggctcaaaaacgccacaagctgccacgacagcgccaaatgctgccacgcaagtgaaaaaaacatagttgcctgcctgtccgttttcagatttgcgaaccggaaggcattcttgcccgcctgccagttcacctgcctgcctgtcagtctgcttgcccttgtgcctgcctgccggcacgctggcatacaggcattggagcggggaaatgccaaagagcataaaccagccaaacaaagaaactgttggaaagcgatggaggaatgtgctaagatgtccacgagactacatttagcacaagtgaaaaagagttcttcatgtttgtagtcaatatgtttgcgaatccgcaagcattcttgcccgccagcctgctcacctgcctgccagtctgcttgcccttgtgcctgcctgccggcatacaggcattggagtgctgaaatgccaaagagcgaaaatcagccaagcaagaaaactattggaaagcgattggtaggaatgaattaagatgttcatgagtccacattggccacaatagaaaaagttctacctatttgtggccaatatgcctgcgaacctacaagctagcattcttccttgccaggtggcaggcattcttgcccgcctgccagttcacctgcctgccagtctgcttgcccttgtgcctgcctgccggcacgctggcatacaggcatcggaatggtgaaaatgccaaataacggccacaagccaaacgcaagatgagtggcgataaggccgggtaaagaacgccacaagctgccacgacaacgccaaatgctgccacgcaacggcaaaaggatacaacctttgagaaagcccctttcctttgcaggcgaaacggtcggcacgcctgcctgcttccgggctgacatccttgccaacctgcctgccagtccgccagcccttgtgcctgccggcacacaggcatacaggcaaaggcttggtggaaaggcaaagggcggatgccgtttcaatgggccaaacgccaggaaaagcggtggaaagggtggccaaagaacgccacaagctgccacgacaacgccaaatgctgccacgcaacagcaaagagacacaaccttggcgaaagtcattttcctttgcaggcggaatggtcggtatgcctgcccttatgcttgcctgccggcacacaggcatggatgggaacaggcataccgggagggatgccggactgcctgctcgcttaccgggcggatggctgccgaccggaccaagaaacggatgtctaacaaataaaaaagaagaaagcatgaaaaaagaacctttgttcatcgccttctccacccagaagggaggagcaggcaaaacgacactcaccgtactgatggcgagttacctgtattacgtgaagggatatgacgtggcggtcgtggactgcgactatccccagttcagcatcaaggacatgcgcgaacgcgacttgaaaagtatcgagcgcaacccgtacctgcgcaagctggcatacgagcagttcaagcgcatcggcaaacgcgcctacccgattgtggggagccgtcccggcaacgcgattgaaacggtcaggccatttgtcgagtcggcgacaccgcccgacttcatcttcttcgacctgacgggtacggtgaacaacctcgacctgatccggacagtagcgacgatggactacatcttctgcccgatagccgcagaccgtttcatcatggaaagctcgctgaagtacgcgggcgtcatcaacgacacgctgatcactaccggcaagtcgaacatcaagggcatccgcctcttgtggaacatggtggacaagcgcgagaagaccgacctgtacgacatctatgacaaggtgatagccgggatggggcttgaagtgctggacaccagtctgcccgacagcaagcgtttccgcaaggaaggctctgaggaaggcgaccgcccgtttttccgctccacgctgctgccgccggacaaggcattggcgaaagggagcggcatcgatgccctcgcggaagaaatactcggcatcgtaaagcgttgaaccgatggccaagaaactcgatgtcgatattgaccccggcaagttcctggattcgttccgtccggaaatgcccgcgcccgcctccccggggagcctcggaacagatggcaacacttccgcaaaggaggccaggctggcggaaaaaccgaaagcaaaggtgggcaaggatgccacggaaaaggaagaggaatacctggaacgcttcctccatgcaccgagaatccccgtgtgttcgggcaagaccgcctacatccgcaaaagctaccacgagcggatacagcgtatcgtgcaggtcatcgggaagaacgggcttacgttgtcggtctatgtggaccgtgtgctggagcagcacttccgcgaatacgaggaagtgatccgccgactttacaagaaaaattacgaggacatttattgattttattcaccctaaaaaacgaaaacaagatgggatttttcaattcgagaatgaaaaagaaggggaatggcaacccgaaggcggacactccccaagtgaacaatctggaaaaggcggacgtagtcatccacattgtggacgacacccaattagaaaaagcggcggtgttcctccgctatctgacgcccagacaaggagcgcaccgccagtgcatttacctcagccgtgagatgcacgggaagctgtcccgcattgtgcggacactgggcgggaacggcagcaccattggcgggtacatcgagaatgtgctggaagagcacttgcaaacctatggggacgacatcaatgccctgttacgccgtgaaacctcgcaaccgctctgacgatggccgagctgctcatcgtgctgatgatggccttcaacctatggatggtcatctacctgacttgggaacgccgggaagaaaacgtacccaaggaggacaaggaaaaggatgtgggcgcaccggaaaggtccggcgacatcatggggaaaagcctgttccggatgcctgaacgaaaaccgcaggctgctgcaccgatgtccaatgccaccgtgcaagcccccggcgaggaggtggacgagaaggacgtggcctttgacgatgaaactgcctcccccaatagccggctttcgggagccaggccgtcgcgccaagtgcccgacgaggaactggacgaggtgtttgccgacaagcgtgtttccgacatcggggcggaatatgacgaagacggagatgatgacggcgagcctcatgaagcgggaggcatgaccttcgaggacatcgaccttgccatgcggacggtgaagaaaccgaaagccacgaaagaggaacgccgtcacgccggaatggtgttctgcgacatgaagggcaacgaactgttcgcgatgatagaaaagagttcggaagcgacccgcaggaaactggacgagctgatggactactatctggactccgtgtcggcggcgcaggcaaacactacaccggtgattatgcccaagaaagcgcccgcagttccggacaacttcgaggacttcaacatccgcgactatgtataacaagtaaaaacgtaacagcaatgcgaaaaaagaaaatcgactacggctaaaccatcggcttgccaccgagaccactaaatcccaaaagccggcttcatccaaagccgcaagaattaaaacaagtatcaaccgccaatgggaacatccaacccggaggcacaaaacagaaaagattatgacaaagacattgaagaaaaagcaaatcatcctcgcggccctcctgctggctgccaacatccaagttttcgcgcaaggcaacggcatggcgggcatcaccgaagccaccagcatggtcacttcctactttgacccggcgacgaaactcatctacgccatcggcgcggtcgtcgggcttatcggaggcatcaaggtgtacggcaaattcagcgccggcgaccccgacacctcgaagaccgccgcaagctggttcggcgcgtgtatcttcctgattgtaagcgcgaccatcctgcgctcgttcttcctctaacaaacgggtatcctatacatatataataaggtataaggacaatggctgagtaccccatcaacaagggcatcggccgtccggtggagttcaagggcctgaaggcgcagtacctgttcctgttcgcgggcgggctgctcgccgccttcatcctcttcatcatcctctacatggcaggcgcgggccagtggctctgcatcggcttcggcgcggtatccgcctcgtcgctcgtgtggctcacgttccggctgaacgcgaagtacggcgaacacgggctgatgaagttgggcgcggcacggatgcgcccacgccatgtgctccaccgcagacgggtgtccaatctgttaagacgaaaaaagaagaaaggaagaaacgtatgagaaacatcatgaaagccaccacgctggaaagccgcttccccctgctttcggtggaacacgggtgcatcgtctcgaaagacgcggacatcaccgccgccttcgaggtggagcttccggaggtctataccgtcacggcggaggaatacgagggcatccacgccacgtggtgcaaggcaatcaaggtactgcccgaccattcggtgctgcacaagcaagactggtacgtgaaggaacggtaccgccccgacctcggcaaggagggcatgggcttcctcgcccgcagctacgagatgcacttcaacgagcgcccgttcctgcaccacaagtgctacctgttcctgacgaagactacgaaggagcgcatgaggcagcagagcaactggaatacgctgtgccgggggcatatcgtaccgaaagaaatacaggacaaggagacggcggtgaagttcatcgaggcggtggagcagttcgcgcgtatcctgaacgattcggggcatatcaaattgcgccgcctctccgatgacgagcttacaggcacggacaaggagacgggcatcataggcaggtacttcgccctgtcgctgggcaacgcggactgtctggaggacatcgagatgacggcaagggaaatgcgcgtcggcgacaaccgcctgtgcctgcacaccctgtcggacacggaggacctgcccgcagcggtggccacggactgccgttacgaaaggctgtccaccgaccgctcggactgccgcctgtccttcgccgcgccgctgggactgctgctgccctgcaaccacatctacaaccagtatgtcttcatcggcaacagcgacgaggaactgcgccgcttcgagaaaacggcgaggaacatgcagtcgctctcccggtacagccgccagaacgccatcaaccgcgagtggattgaagaatacctgaacgaagcgcactcgcaggggctgaagtccgtccgcgcccacttcaacgtgatggcgtggagcgacgacgcggaggagctgaaacgcatcaagaacgacgtgggcagccagatggcaagcatgggctgtgtgccgcgccacaacacgacggactgcccgacgctgttctgggcgggcatccccggcaacgcggcggacttcccggcggaagagtcgttccacacgttcatagagcaggcggtgtgcctcttcgcgggcgagaccaactacaaggactctccgtccgccttcggcatccgcatggcggaccgcatcagcggcaagcccctgcacatcgacatctccgacctgccgatgaagcgcggcgtgacgaccaaccgcaacaagttcgtattgggtccttcgggcagcggcaaatcgttcttcatgaaccatctggtcagacaatactatgagcaaggctcccatgtggtgctggtcgatacgggcaactcctaccaagggctgtgcgagatgatacaccgcaagaccaagggaaaggacggggtttattatacctatacggaggacaacccgatttcctttaatccgttctacacggaggacaaggtgtatgacatcgaaaagagggaaagtatcaagactttgttgctgacgctgtggaagaaggacaatgagcctgctacccgtgcggaggaggttgcactttccaatgccgtgtcgcagtacataggacgtattaaggaagacaacagcattgtcccatgcttcaacacgttctacgagtttatagacacggattatcgcaaggtattggaagataagaaagtgcgtgaaaaggactttgacattgccagtttcctgaatgtgctggagccgtactacaagggcggtgaatataattacctgcttaattcggacaaggaactggacttgctacacaagcggttcatcgtctttgaaatcgaccagataaaagagcacgccatcttgttcccggttacgacaatcatcattatggagttgttcatcaacaagatgcgccgtctgcaaggtatcagaaagatgataataattgaagaggcttggaaggcgattgcttcggcgaatatggcttcctatgtaaagtatctttataagacggtcagaaagtatttcggcgaggcaatagtggtgacgcaggaggtggacgacatcatcagctcgcccatcgtcaaggagtccatcatcaacaactcggactgcaagatactgctcgaccagcggaagttcatgaaccgcttcgaccagatacagggattgctggggctgacggaaaaggagaagtcgcagatactttccatcaaccagtccaacgattcgtccagacgatacaaggaggtgtggataggcttaggcggcacacagtcggcggtgtacgccacggaggtgtccatacacgaataccttgcctatacaacggaggaaacggagaagatggaagtccgcgaactggcggggaagctgggcagcgacatggaagccgccatacggcagattgcggagaaacgtatggacgaagaaaagtaaccgatggaaacatcacccgaccacagacggcgtttgaggccaccttatacggcatataagggtgtatcaaacggcgtatgaggtcaagacacattttatcaacaaaaaaacaagaattgaagattatgaacattgaactgacaaagacacaacggctgctgctttgcggcggtctgataggcttggcgtcgctgatgctgcaagcctgcgagacggtaatgaaagaaaacgaagacatccgcgagaagatttgcggcaactggcagagcgtggagggcaagcccgacatattggtgtacaaggagggcgcactttacaaggtgacgctgttccgcagggcgggcgtccaccggaaactgaagccggagacctacctgctgcaaagggaggcggacggtaacctctacctgaacacgggcttccgcatcgacgtggcatacaacgaggaaacggacatcctgtccttttcgcctaacggcgactatatccgggtgaacacggatgaaacagccaatggcgaaaagaagaaagaacaataagaatgtaccactaaatccaatgtgaatatgagacaaaaactgaaaatgccattggtggcagcctgcctgtgccttgcaggtgcaggcacggcaaacgcccaatgggtggtgtccgacccgacgaacctcgcgcagagcatcatcaactccgccaaggagatggtggaaacggcgggcacgaaagccaacacgctcaacggcttcttggaaaccaagaaagtgtttgagcagggaaagaagtattacgacgcgctgaaatccgtacatgacgtggtgaagggcggcgtgaaggtgtcgaaaagcatcgggttggtgatggaaatatcagaaatctatgtggataactaccagaagatgctctctgatgagaactacacgccggaagagcttgccgccatatcgtcgggctacaccatgctgatagacgagagttcggacgtgctgcaagacctgaagaacgtggtgaacgtgacggggatgtcgctcacggacgcggaacggctggcgattatcgacaacgcctaccgcagcctgatgaactaccgcaacctcgtgcgctactacacgaacaagaccatatcggtgtcctacctccgggcaaggaagaagaacgacatggaccgggtgataggactctacggaaaccccaacgaaaaatactggtaagttatgggagagttcgacaaccttcaccagatactcctttcgctctacgacgagatgatgccgctgtgcgcggacatgacgggcgtggcgaaagggcttgccgggctgggcgcgttgttctacgtggcggtgcgcgtgtggcagtcgctcgcccgcgccgaggcgatagacgtgtacccgctgctccgcccgtttgcgctcggtttgtgcatcctgttcttcccgaccatcgtgttgggtacgatgaacagcgtgttaagccccatcgtgcagggcgtacacggcatcctcgaagaacagaccttcgacatgaacgagtaccgggagcagaaagacaaactggaatacgaggcgatgatgcgcaacccggagaccgcctacctcgccagtgatgaggaatttgaccgccagttggacgagctgggctggtcgccctcggacttggtgacgatgacggggatgtacatggaccgggcggcgtacaacatcaagaagacggtgcgtgactggttccgggaactgctggaactgatgttcgccgcagccgcgctcatcatcgacacgctcaggacgttcttcctcgtggtgctgagcatcctgggaccggtagccttcgcctttgccgtatgggacggcttccactcgacgctctcggcgtggttcagccgctacatacagatttacctgtggcttcccgtgtcggatttgttcagcaccatactggcgaagatacagattctgatgttgcagaacgacatacaagcgatgcagaccgacccgaacttctcggtggaggcgagcaacggggtgtacatcgtgttcctcatcatcggcatcgtgggctacttcaccatcccgacggtggcaggctggatcatccaagcaggtggcggcataggcagctacaacaagaacatcaacaccgccggggctttgggcggcagcgtggcgggagccgccgcaggaaacgtggcaggccgcgcgggcaagctcatcaagggaacggcgggaaagctgttccgaagataggcattccggacaatccgtttccgtgagttgcccgacccttaaaaacggattattgaacaattaaaagacgaaaagaagaaaatggaattcaaatcactcaagaacatcgagacgagtttccggcagatacgtctgttcggcatcgtctatacggcggcctgcgccctcgtggtggtctgctcggtggtgtgcgccttccgcttcgccgaggcgcaacggcagaagatatacgtcctcgatggaggcaagagtcttatgctcgcgctctcgcaggacctgtcgcagaaccgcccggcggaagccagggaacacgtgcgccgcttccacgaactgtttttcaccctctcgccggagaaaagcgcgatagagcacaacgtgaaacgcgccctgctcttggcagacaagagcgcgtacaactattacgccgacttcgccgaaaagggcttctacaaccgcatcatcgccgggaacatcaaccaagtgttgcaggtggacagcgtggtgtgcaatttcgaccgctatccctacgaggcgcggacatacgcccgtcagatgattatccgcgagagcaacgtgacggaacggacattagtaaccgcctgccgcctgctcaacgcgagccgctcggacgacaacccaaacggcttcaccatcgagggcttcacggtattggagaacaaggacatccggacgattgaaagataatgcgtatgggaaagatgaaaaatctcattgaaaagtggaccaccgggctgaaaggttggttacgcaataggctggacgccctgccgcccaaagcacggcttaggatagtccttgcggcatttgccgtgttcgcctcgctctgtctctacatgactgccgccgcaatcatcggcttcggcaaaggggaagaggcattggagatacggcacatcgagaagttagaaatatataataaggtgtatcactcaaatttgaatccacaatgaaattatcagattggatatgggaaaagatggaaaacttgcaggatgccggattccgatggaaaccgaccttgaagttctgccatcaggtgcttcgcttggattacaatgccattgccgattccatcgtaaggaacgggcatcgcccggcaattacggaagagcaggcaaaaatactctgggattaccgtttcttccggaatctggaccagacggaacgcagcggctggcacaaggttatggatgtactgcaacaaaccgattggggcaaacagcaggtctggttgttgtccggattgaaaatggggaatgaaacacttccccaaaaactgaatgccatgtacacgctgctttgtagtgcccatacgggtaaaagccataccctatgtcctctgcccaatccggaagaagtggctaccgcccataagctggtagggtattgcatgaaggacgaggaactcgactacttgaagcggcttgccctgcatggggaatatccgggagacctgaccgccatcaggcatggtctgatggatatgtaccaaaagatagaggacctcgaatgggaacgggccaaggaaatgcgtgcggacaatcactggtcggcggactccatcgatgcggccatccaggaggaaaaaggacggattatgcgcagtgcctccgatttgtacgagcagaaagtgcagggcaagttcccggacgactatcggaaagccctgcaccgggaacggatggtgcttcatggactctctcaaaagggatgggacgggcagacaaaaattccgaaacctctgttggtcaagtatgggttggcggaatcattcggaaaaataagcgatgcgttgatggattacattatccgttgtgacatgggagacgatacttatcccaagcatatggtagggcatcataaccgcatcatcaaagaacagtcccggataggattggaacgcttggaacacaggttgtttccggataaaaacaaaccaaagctccatccggcttctttgggtacgcataaaatgcccattcgcttacagaatcaggtaagcaaagagaataaaggtataaaaatcagactttgacaagctaattgaactgatgatggaaacaaaagaacagaagaatgaatcaagaacaaaagagaaaaagccgctgacggaacaacagcgtcagcaaaggcagaagatgctggtctatccgctgatggtgctgctgttcgccgggtgtatgtggctcatcttcgcgccgtcctccgaggacaaggagaaagaacggcagggacagggattcaacacggacatgcccatgcccgaagactccaaaatcatcggggacaaggcgaaagcctacgagcagcaggatttggaaaacaagcggaaggaacgccggggcatggtgggcgacctctccgcgttctggaacgacagcgacggtgacacgccaacggacgatgccgacacttcggacgattaccgcctgacacggacggaaacgaccgacggggaaacggcggacgaaagacaggcgggcatccgcacttccgctgccgcctaccaacggctgaacacctcgctgggcacgttctacgagccgccgaaggaggacacggaaaaggaggaactccgggagcgcatcgacgaactggaagccatgctggtggcgcaggatagcaagccttccacgatggaggaacaggtcgccctgttggaaaagtcctatgagctggcggcgaagtaccagaatgacaacaatgccggacaagccgcacagcccgatgaaacgggaggttctgtgagtacaggcgaaaagagcatgaaggcagaacccgtaagcgatgtaaggcggacggtggtgtccgccctgccgcagcccatgacagactcggcgttcatcgcggactattcgggggaacgcaactacggcttccacaccgccatcggtgcggaggaaacgacggggaagaacaccatcgccgcctgtgtgcagggcgaccagacgctgacggacgggcagacggtgaagctccggctgctggagccgatgcgcgtgtcggggcgcgtcatcccccggaacacgctccttgtgggcgcggcacggttgcagggcgaaaggctcggcatcggcatcacctcgctggaacacgggggaaacatcatcccggtagaactggaggtgtacgacagcgacgggcaggcgggcatcttcatacccggctcgatggagatagacgcggcaaaggaaatcggggcgaacatgggcagctcgctcggaagcagcatcaacatatcgaccgacgcgggggcgcagctcgcctccgacttggggcgaggggcgatacagggcatctcgcagtacatctcgaaaaggatgcgcacggtcaaggtacatctgaagtcagggtacagggtattgctctaccaagaaaaggaatgaacagtccaaaaacataaaggcaaaaaaagaaaaaataatcaacaaactaatttttatttaccactaaatccaacgtaaaatgagtatcaagaaagtaatgacaatgtttgccctgctgatgggcatcgcctgtgcgagctacgcgcagggagtgacgaacgacagcactgccaccgccaaggaggacgggctggaactggtgaaggacgtctatccgcagacggaggaggacggcgacctgtaccacggtctgacgaaaaagctgatgttcgaccgcatgataccgccgcacggcttggaagtcacgtatgacaagaccgtccacatcctgtttccggcggcggtgcgctacgtggacttgggttcgcccaacctgatagcgggcaaggcggacggtgcggagaacgtcatccgtgtgaaggcgacggtcaagaatttccgcaacgagacgaacatgagcgtcatcacggaggacgggtcattttacacatttaatgtgaaatacgccgatgagccgcttatcctgaacgtggaaatgaaggactttatccacgacggcagcacggtgaaccgaccgaacaacgcgcaggaaatctacctgaaggaactgggcagcgaaagcccgatgctggtacacctcatcatgaagtcgctgcacaaggaggacaagcgcaaggtgaagcacatcggctgcaagcgtttcggcatccagtacctgctgaaagggatttatgtccacaatgacctgctgtatttctacacggagataaagaaccaaagcaatgtgccgtttgacgtggactacatcacgttcaagattgtggacaagaaggtggcgaagcgtaccgccatgcaggaacaggtgctgttcccgctccgcgcctacaactacgccgtccgtgtagccgggaagcggtccgaacgcacggtgttctgccttccgaagttcaccatccccgacggcaagcagctcgtggtggagatgaacgagaaggacggcggacgccaccagacgtttaccgtggagaacgaggacttggtacaggctgaaaccatcaacgaactgcgcgtgcgatgaaaggaaaggtactgtttattgtaacgcttctgttcgtcctcctggcaggacgggcggaagcccaacggtgcctgccgaagatgcggggcatcgagttgagagccgggctgaacgaggcggacggctatgtgctgggagccatgctttcgagctacgcgaaaggtgggaacaagtgggtgtacgggctggaatacctgaaaaccagccacggataccggagtacgaccatccctgcggcacagttcacggcggagggcggttactactacaacttcctctcggacgcgaaaaaggtggtgttcttctacgctggcgcgtcagcccttgccgggtacgagacggtgaactggggcggaaagacgctgtacgacggggcgaggctgaacaacaaggacgcctttgtctatggctgcgccgccacgctggaaatggagctgtacctcgtggacttcattgcgctgacggcctcgctgcgtgaacgcttcctgtggggcggcagcatgggcgtgtgccacacggaatacgggataggcgtgaagttcatcatcaactgaatgtgcgcctatatggatatagaagcgatgaaacgctatccgctggaggacttccttgcacggctggggcatcatcccgtgcaaagacgtgccaacgccatctggtacaggtcgccgtaccgggaggaacacacgccttccttcaaggtaaacccggaaaagaacctctggtttgattttggcgagggcaagggcggtaacatcttcgcccttgcgggggagttcatccaaagcggcgacttcctcacacaggcgaggtatgtggcggaggtggcggacatgccgttgcaggactatgagcaacgccgcacccccgaagtgcggcaaccagccggacacagcttcgaggacgtggaagtgctgcccttgcagagccgggcgttactccattacctgcaagaaaggggcataccgtccgccatagccatcgcgaactgcaaggagatgcgctactccacgcacgggaaacggtatttcgccgtggctttcggcaactgcggtggcggctacgagatacgcaacccgttcttcaagggctgtgtgccgccaaaggacgtcaccctgctgccgtcaggctctgccgtttgcaacgtgtacgagggctttgtggactacctttccgcccgtgcattaggcatcggcggcggggaggaccaccttgtcctcaactcggtgtccaatgtggcgagggcgtaccggcatctggacggctacggaacggtgcggtgccaccttgacaacgacgaagccgggcggcggacattggaagccctgcgcacacgttacggcgaaagggtgtcggactgctccggcatctacggcggatgcaaggacttgaacgagtatctgcaaagccgtctgaaacaaaacgagaagaacaacaagaacatcaaacttaaaatgtaacggttatgaacatgaacaaattaaacaatacacggaaagtgaaaagaaacatagtaaaatcattggcaaccctttgtctggggctgctctctgtatgcttcaccgcctgcgatgacgatttggacgtgacgcaagcctatccgttcacggtggaagccatgcccgtgccgaaggaactggcgcagggcgagacggcggaaatccgttgcgaactggtacgcgagggcgagtttgacggggcggtctataccatccgctatttccaatacgacggggagggcacgttgaagctggataacggcttggtgttgcagcccaacgaccgctacctgctggagaacgaaaaattccgcctatattacacctcggagtgcgacgagtcgcaaagcctgaccatcacggtggaggacaatttcggcaatgcctgcgagtgggaattggagttcaacaacgactcggacgcggaaacggagggaggcgtcgctgtgtctgacaccttgaacgccagccgatgatgcgcaaggcgttgctcctgctgctggcggctgccctctgtggcagcctgccggcacaagacacggacagcatggcggaactgctggcatcgtttaacaatcatcccaaggctgacatcgccgttgaactgataaaaaagtacgagggactgcacgaccgttccgattacccctactacggctacgggcatcgcaggttgcccaacgaaaacctttcctatgacatgacggaggcggaagccgaagccctgctccgcaaggatttggcggtgcgctacaagctgttccgcaaatttggtaaagatgccttgcttcttaccgtattaagtttcaatgtgggtcaaggggtattgcttggtcacggcggacacccgaaaagcaaactcatccgcaagctggaagccgggaatcgagacatttaccgtgaatatatcgcttactgccggtacaaaggaaagcagcacgccatgctattcaatcgaagaaaaacagaatttgcgttgctatatattccgtgatatgattaaaattccttgcggtaaataatttcgcaaggaatttttgcttccaatacaaataaacatattatctttacaaataaattttcgaaaaatgaaagagccgaaagaaatctattatttacctgtagaacagttatctgatgatgttattcaatatattgaaaaagtttttgagttattagatgctgtaaaaaatgattgcaatagcaataatttttctcgccgatttactttcataagagatgagaaagctattagtgatgttgcggaaattaaaaaagataataataaattaaatcatatatatatcaacgaaaatttctgtcagtatttatggtctgtttgtgtctatcttatcgcatattttgaaaatgttatacatatccctatgatggatgctgttggtattaataaaaatggatataagcccaatatgatagatgtagaatatggcaatgattgttttttcagaggacggcaattattacataactttaatagagatgcatattgggttactccaaatatctgtaatccgcagcaatttgaaaatattataagccatgcgaatgatgtctattgtgctgcaatagcatttatatatgctcacgagttttcacataattatttggggcatacacaaatacagcaaacgctttctcgttcaataaatgatgaaattgcagcagatgatatggcaattagctttattcaaactgaatataactctgcatggggaagaacctataaggcaggaattgcaactacattagcagcccttttattaatgggagaggattctatttctggtggtggaacccatccagatatggatgttcgaatagaaaatttggttactaaactggaattgcacgaaatggatcttctttggggctatttaggggttgctttaagattatggcttcttgtttttgatggcttatccatcaaagaggatatgcagcaaccggggtttggttcatacaaagagatatatttatattatatagaaaaattaaagattgtcaggcaacaacgttatcctacaattatcaaaccagactgggatatataattaatgacttcattggatttttccatcttatcgaagatgggggcaacggtttctttgctactttcttatccgccgacctgctcatgaaagaaagtagcgggcggcaagcctgccgcccgattttaccgctttatcctttgcagcacacgctcaagtgtgcgctcggcaatggggcgtgtgtccttgttccaaaggttatacccgtgtacggatattcccacgctccgcaaatctcggatataaccggacgcttcatcttgcgtgggcaggtaaacgaactgcacccatgcgtccctgccgtctgtcagtatgaaatagtatttcatttcgcttgttttttcagttgttacgaatggagtgtgggcggtgtttccaccgccacgcactcaaaattcctttatgtcggcgatagccgtgcagcgtgtgagccattcctttacgcagggcatgttgtattcggaagtgatgactgccgtatgcccgtttatctgcgtaaacctcgtactttcatagtcctccacccatcctttgaggctgtccgttccccatgcgtccgcatcggcgaacatattgtccaaaaccttgatagggtcgctgaacgtcactatcagcgtttcatatcctgcgctcatcgtctgccctccttcgctttaatccattcgtcacgcaaccgcctgcactcgtccaatgtgggtttcacgcaggagaacagttctcccgttgtggtgtcccgatagtcatattggtacatcgtgcggactttgcgcccgattttcagttggaatttctcgtatttctcacctgccgtgcaggtgcttactccgttaatagtcattcttgttgtcatagccttatcaattaaaattcaacaatcagtaatctgttctccaaacattggtcggggtcggatgcctttttctgtgtcacccacagatggtgtgcgccatacccgaatgcgaaaagggcgttgaaaagtttctttcgggcgaacacctccattaccccccttacatcctgctcgtcctttgtcagtacaagcgtgttcaacaattcgatgaacatttcaggcagtttctcgtgccacccgaaaatcatgttttctattctcacttccatatcaataagtattaagttgttaaacgattacgctgcttctttcatccgtttccgtatctgctcggcattgtcctccaccaatttgatgatgcggtcgtggtattcggtgttggagttgcatacgccacggctctgcaccacttttaatgtccgcaagtccacctccactgtctcgatgcgtcgctcgtctatccgtgcggaaagtatcagggagttctcattgttgtagtaggcgttggcatagacgcaatggtgcatggctttcccctcctcgtagaactcgtccacgctttgcagcaccttgacgatgattagaccgtccgtcagtacaaggttgaggaatgcggctttctttcggatatactcgtctttctctttcgccatttcttccagacgcttccgctcacgctccaaccgctcggcttcccactccctgtgttgctgctgccgttcacgctccaattggacttgccgtttccccatatacaggtcgtgagccgccttgaaatcgggcgggcatatgaaacgggggttgcgcaaatcttttcccaatctctctaagagatatacgaggtcgcaccacaatgagatgtcggttatggcatatttattccgcatggctatcttgtacgagttccaacatctgtcaagtacctgcggacgggagaggaaatagcgcaagtgttcgatgttgcccgacttcagcaatgtttccgcacggctgtccgaaaggatagccttgaagaagtcgtaaggcagtatgccgtgcaggttgccgtcaaagccatttcgcttaatttcggggataatccgtcggcgtggataggtgcatatcgggtcaatgtcatacaccttatgctggttgttcctgcggatttccatcgggctgtcctcgttccacaagtcgtagtagagaagtgaaaagccacgcaaccttgccactgtctcggacttgccgtcaggagcaatccaccgctgtgccacctcaaagatggaatactccgccttttgcccgactttctgacggctcctgacgaaaaagaaacgtattacctggtagcctttgcaggtggtgatgatggagaaatactcgttgtccacgaacaccctctttcgggtgtccgtgatttccaatgccgtgccgcagttcgggcaggtgcatccgcaaagcgtgtcggcaaggctgtgtccgcttttccatgcgtgtccgcactccgtgcaggtaatgacgccttttgcagtccgcctgccgtagtgcttgaaacaatggtggaaagcgtaggttctctgtgcgtttgtcagttcgggcagggttgcgctcagacggatgacttctttctgtatgggtgtcttgggtttcataggttcagaataatgaaagttcaacttgttgtgcgtttgtcttttggttcgccttagccttgttccggttttgcatcttgcgcagttcctcgtcttggtattggcggatggctctctgccttgcttccgccttttcctcgtccgtcagttcaactccgcataccatgacttggcacgggattggtttgccgatgtcgatgtcgtcctcgtcaaaatagtgtaccgcttgcgacaagacttcccctgcggtaacgcctatgccgttgcctccattgcattggcttttcgcccaatgcaacaaataggtgatgcaatcgtccatgttcttgttcggcttgctgtaacttgctgcaaacagcttgtcctccgccgcacggctgtccaaataggcttggatggtccgcttgaaatggtctgttccgttcatatctgtatgtattttagttatttgaaaaattctccgttggataaaaactcgtattcgttggcttcgcaatcacgctcaaaggcttcctcgttgctagcatattccacatcatccctgcaaaagcggaaaaagctgtcgatgcagtcattcatcaagtcatacaagttcgtatgcttgtcggggactttcagaaagtcgtatatgggtttcagtatgtccatgtccgcacaataacccgtcagcacacaatcattggttacggatatccgacttctgcgctgtttgtggaagtcctttttgtgccaataggtcttgggcttgaaaaggttgtgccaatagttgttcacgatgaatttcagcaaccgcacaccgcacagttcttcctcttccccgctgtaatttgagatgaattggaaattataggtacaggcatcataattccacctgcttacctttaccttgaaaatctcctcaaaggctttcaacgttgccctgttgtcggatgcgtcatattcaaagcctttcaaccacttccaataggcgttctctttcgccttgtccgaaagctcgtccaccttgtaaacttcgtatttcctcgtttccgttctcataactttgctctattgttcgtccaacatattgtgataaaacaactcgtcatcccgtccgtagatttccatcgtagggttgttgtcgttttccgcaggggacagtccttccaccgtttcggggttcaattcgtagtcgcaatagatgacgttctcgtccataccgatatggctgttcacgtctttatcttcccatgaaagaatgatggatttggcttcttcatagctgttcgctttgatggagaagcgggtacgttcccagcaagttaccttgcaatccatataaaagtcaaaagtttccattgtctgtaatttaagatggttatacggttttctgtaaaatctctatgtggtattggggcgggcattccaagatgagaaaggcgatgaagtcctttcttgcctccttgttcaactcgtggtacaacctcctgaatgaggaaaagttaccgttgatgcacacctctaccatatactcgaagatgttgtccacctcgtaatacctgcattgttgtgccactgtcttgctgtgtcttttcgccatatccgtatgaattaaagggttaataaccaaatgaaaattccgatagctgccactactgaaagcagggcggtgaggatgccgaacatgaagttcaacatacccagcaggatttcccctgcgatgcccaccgccaaacctcctgcgcaaagggtaatgccccatgctgctctcaccattgcggacaatacgctccgcatagcctttccgatgtcgttcaatgtcattctcatatcttccaatttttagattgttgttacttgtcttgctcggatggggaggtcgggtcgagtcctttttcttttcgcctctccgtatgtccgatgtctccttgtgacgtcttccgaccgcgcaccggtcgttttcgtttcaggggaaaaagcaaaggtcaggggagtaggttcagcaaattttttcgacagaatactacctgagcctgcgaagtgtggagattgtggctaaaaaatttgtgttcctaatcccgtctttacctttgcccctgcaacgaaaatgaccactgatgccgtctggaatggcggcatggggacattggcatacacttggagagacggaaaggaaaagggggaagtatgtgaaatggcgcaacgcgccacaggaaaatcgaaagggcggcgcaactgacaagggaaagcctcgctttcctgccgccgtgacggaagtcccgtgaccgtcattgtcatgcgggcatggcttgcggtcgcgggtgttcctccggcggcatctgtctgaaaatggtcttgcctgccattgctccgattggcaacggcagggcaagacggttggaagacaggccacacatgacagccgggaatagtcgcaggagcagattcacgcttgccgtgtcctgcatccggcggcatttccggctgacaacggaaacgaaaaaagaaaaacgaataagacggtcttggccgttcagcacaagcacataaaagaagtgtccgcgacgatggcagtgtcactggtgacattgtggtcgtcgtgggcttttctttgcttgtgctgcttctgaaatgggcttgcgcacatcaagccggaagccgttttcagaacaggaaaaatgatggaggataaaatttgcgggcgaaataaaattgcgggaaattttgcaaagacggggactgttttgtacctttgcaaaaagtaaggacgttctttcgcttgatgcaaaatgaggcagattatagaagttcgctggtttctaaaccgttaacaagtctgttttgtttctctgttaattatctcatagcttgaaagatacaatttttattgtgtcttgcaacatgcgtggtcagattcttcttaatgccgcagaaatcggctatttccttgaggtagctgttcatcttctggttgcacatgacgggcaaacagcatccttttttaatgcaggtcggatgttccttgtatttctccaatatggccaggggtacaggcagcaatggaatattgctgatggaagaggccttcctacggtgttccaatttgacccttccttttcttatccaccagtctccgagattgtcctgtaccagattctctttgttcagactggcaacatcggagaatgccagaccggtgaaacacgcgaagacaaagacatccctgaccagttcaagccgtggaatggtgaatttctttttcattacggtctgcaactcgtcgtaggttaggaataccggatcggtctcgtcctgctccatcttgtaaccgtaaaagggattcttgcgcatccattcctttgccaatgccatattggtaaatttcttgaagcatttcatataacggactatcgtgttccggcacagtcctgcctccgttttcaggtaaatgtcaaacgcacggatgaactccggtgtcagctcatggaaagtgacatcctcctttccataataagaggggatgagcagctgtaatttcttcaccacgttcttataccggttgatcgtgacgggagagtagtctataccctccagtatttccatttccttgatgccttccctcatgatgccgagcagtgtacgcatttcggtgtctttcccgaaaacacgtttaagaatcagttttggggtaatcagggcctgttccaataccagttccttgtgtttttccaaggcgcgtgcgtgcagttcggcaatataggcgttcagtgccactgatgccctgtctctgcctttactgcatcctttggcggcgttccataagttcaggggtacgcttctttggatacgtacatcgtcatagtctccattgatggttatccgcatcaataccggtgcctcaccgtttttcaacaatttcgttttaagcacgaaaaacagaatgttcattgttccttgtttcatcacttttgttttttgaggtgttacattcaattgtttcgtcaaaaccggatggcatgaggacatggagcgaaatgttaaattcggtggtttttttgagggacttgtggaaaagccataaaaatcccatttttctcaggttcgaattgccttttgtatcccgggttcgattccttttttttatcccgatgggaaataccgaatttttaaatttctttcactttttcgacttcatccggtcatgtgtgcaaaattactttttcacaccagagattggaattgtcaaacaattgaaaaacaatgaagtatggtacatatttatggctttttcaaaagccttaaaaaaagccactgaattggcgaaatccaacttcacaaatatgtagcggaatgcgtagtgagggtaaaaaaaagaacccttgaactatctctaattcaagggttttctaaaattgaaaagctttttggtggtgccaccaggaatcgaaccggggacacaaggattttcagtcctttgctctaccaactgagctatggcaccattatttcttgtttgcggttgcaaaggtagtgaaacttttttaaactacaaactatttctaaaaaaaaacactgataaaaacataaggtgcttattatcagtgttgtttaattaaaattatttttcttttagtggattccaaccttgcgctttcagctcaaactcttgtccgtcacgggtaatcagggcacatcccagctccggtttggtgatgtgaccaatcacttttataccctctatagccgaaactcgttcatgctctgttaaaggtacagtaaataatagctcatagtcctcaccaccatttaaagcacatgttgtcacattcatattcagttcttccgccattacagccgtttggtaatcaatgggaattctttcctcgtaaatgcgacagccggtatcgctttgtgagcatatatgtagcagttccgaagaaaggccgtcggaaatatccatcatagcggtgggcttgattcccgcttttgccagtttctcaatgatatccttacgtgcttcaggctttaactgacgttccaaaatatattcttttccggaaaaatccggatttgcttctttttctccttggaaaacagccttttcacgctctagaagttgaagtcccatataagctcctcccaagtcaccgctgacacaaatcaagtctgtatcttgtgcgccgttgcgataaaccactttgtccttgtccgcttcacctatgcaagtaatactgatggcgagcccggttacggatgaagttgtatctccacccacaatatctacatggtgtagttcacaagccagttttagcccatcatagaactgttctaaatcttcaatacaaaagcgtttggacagtgcgatagaaactgtgatttgttttggagtaccattcatagcataaatgtccgagaagtttacgatggccgatttatatcccaaatgtttcaatggggtataaaccaaatcaaaatgtaccccttccatcagtaagtctgtggtcaccaatacctctttatctttaaattccaatacggctgcatcgtctcccacaccatattgggtttccggattttttaactcgatatccttcgttagatgtttaatgaggccgaactcacctaaggtcgctatttctgttctgtttatttcctgcatgttcttaaattcgattaatcatttcacgcataatggtagtcatgcgcggttgcgcttcatctgccgctttctgaacctcttcgtgtgaaacttccacaatttttccctccacgcctaggtcggtgataaccgatactccaaacactttgatgccacaatggtttgctacaataacttcaggaacggtagacatacctacggcgtcagctccaagaatgtggaacatcttgtattctgccggagtttcgaaggtaggtccctgtgtaccgatatatactccttgttgtactttgatacctttttctttagcgatctccagtgctttgtctatcagttctttggagtaggcttcactcatatccgggaaacgggggccgtattcaatgttcttgccgtgcaacggatgttcgggaaaaaagttgatatgatctctgataatcatcagatcaccaatttcaaagtctgcattcgtacctccagctgcattggatacgaacaatgttttgatgcctaattcacgcatcacccgtacggggaaagtaacttctttcatggagtatccttcatagaagtggaaacgtccttgcatagccatgatgtctttattacctaatttgccgaaaatcaatttaccgctatgtccctctacggttgaaacagggaaattagggatatctttgtaactgatctcgtatttatcggtaatttcgtgtaccaggcttcctaagccggtacctaatataatagcagtttcgggactggtatgcatcttttctctaagaaaagttgctgtttcttgaattttttctaacatagtcggttatatttgagttaaacagttcttgttggtcttgtaaaaaggctacctcaatgggcagcatatatatataaggtttcagcatttcgtccatcagtggatgggctgctagtcgtacagagtctttttcagtggtgataatcatgcgtttaccttccggaagtttcatgaaacgcttctttatcagttccatatctcttgctgtaaagtcatggtggtcactgaaagccagtgactcaatgtgctcattgtatggtgataaatcttgaatgagttttgctggggaggctatgcctgtcaccaataggatatgcttgtctttttctatctcttttaatgaaactgcattccctgctgtaaacaacggatgcagcttgccgtatgttaatgttgtgaagtagagctgctgataggggtaaagttccatttgcttgcttaagactcttaaatccataggggtgatgtccttaggacatttagtgacaatgacaatatgtgcccggctttttccgttttcaggttcgcgcattcgtccggcaggcagcaaggtgtcttcgcaaatcagtcggtggtaatctactaataagatgtttattccgggctttacatatcggtgctggaaagcatcatccaaaataatcacttctgttccaggggcgatgtgactattgcataactgctctatgccatgacaacggtcccggtctactgccatatggatatccggaaacttctgtttcatttggaaaggttcgtcacctatcatctgtacggacgtatccggtctggcaagtacaaagcctttggatttgcgtttgtagccgcggcttagtacggctactttgtaatctttctgcaataatcttatcaggtattctgtatggggggtctttccggttccgcctacggtgatgttgcctaccgagatgaccgggatatcaaacttacgttctttgtatattccccagtcaaacaatttattacgcagccatacaccggtcccataaatccatgaaaccggatatagccacttgtttatcttgataagattaccttccatgtgcaatttattggatattagggtcaaacggcatacgtgcctgtatacagttggcgtcttttatgttctccagcgccttgaagctgttataatagcttcccaaatattctttaatttcgctgtttatataatgttttttctgatttcccagcaggcttgcgaaaatattttctttttcaggatagccgataatactgtaattttcgataccggcttgggtggcggcggcattcaatgctttgtctatacctcccagctcgtctaccagaccaaggtcttttgccatggcaccggtccatacacggccttcagcaactttttcaatagcctctgtagacatttttctaccttcagcgcaacggtttacgaacagcttgtatcctcggttgacatagttctgcattaattcttgttctgatgcatttagcgggcgggtgagaaccggacctaggctggcacccaaatcagccattttattagttttcactacatcaaaatttagtcctaaagtttcagtaaacagtttctcacctgaatacatcatgccgaatatgccgatagaaccagtcagcgtagtcgggtcagcgaaaatgcggtttgcagcgcaggaaatgtaatagcctcctgatgcagcataatctcccatagaaacgattaccggttttttctctttcagtcttactacttcacgccatatttgatctgaaccgtatgcgctgccacccggtgagttgacgcgtaatacaacagcttttacgtcatcgttatcacgtaatttgcgcaggtctttacacatcttttgtacatcaatacaatcttctgtggaactgccgggagcatccaggatctcgccgtatgcataatatacggctattatatttccacttttgtctttgggcacatttttcttgacgtttatcatgtcttctatgaaaagactgtttagtttgtcgttttcgtcacgaccgcttaattgtttcagataggaaataacctcatctttatacatcagggtatctgccagtttgcattgaatatattcttctgcctgacaaaaatccatatatcggtcagcataagcattcagagtatctgtcgggatgcgtcgtgagtcggatacatctgcaagaatacgatgccagacagattccagacattcggtcatctgttcgcggttggccggactcatttctgtagcaataaacggttccacggctgatttgtaagtgcccactctgaatacctgtacttccagtcctagtttggaaaccagatttttgaagaaaacaggttgcatgcctgctccgtgccatccaatacttccttgcggattgataattattttatcggccacgctggaaagataatacatcccctgtgcatattggtctgcataagcaacgatgaatttgccgctttctttgaaatccagtaatgcattgcgtatttcctctaaggaagcgtatgatgcttccagataagaaggttggatataaatacccttgattttgtcattgtcttttgccttcttgatagaagctagaatgtcatccaaaccgtatgcttcaaattcttctcccaaaagttgttggagtgggttttcctgtacacgttcggacaaactgcctttaaagtcgagtacgaagatagagttgtctttcaccaccgtttcagtatccgatgaggcgactatgccaaccagagtgataatccctagtatagtgaacactacgcctgccagaatgacgccgatgacgctggcaaacgtaaattttagaaaatctttcattgaatgtgttgtttttaatgttaataattagctaacaaaaataggttattgcattgaaaaaagcaaaaaaagtgaacttcttttgttacctgtttgttcttcatttataataacccataaatacgttgttttatatgacaaaaagttttaaggaggctctgaaagcccgtcgtacattttatcggatccaaaacaaatcgacattgtctgataaagaaataagagatttaatttgttttgctgtagaatttgtcccctcagctttcaattctcaaaccactcgtgttgtgttattaacaggtaaggcgcatgaaaagttgtggaacattgtaaaaaatgtcttgcgtaagcgagttccggctgaggtatttggcaagaccgaagaaaagattgatggctgtttcgcttgtggatatggtactattctctattttgaagatatggctatcgttcgctctttgcaggaaagtttccccacttataaagataatttccctatctgggcagagcagaccgatgctatgcatcagttggcagtctggaccatgctggaagatgcaggaatgggggcgtctttgcagcattataatccgctgattgatgatgaagtacgtaaagtttggaatttgtctgatgactggaaattgatagcgcagatgccattcggtgtgcctgttgcacaaccgggctttaaggaagtgaagtcattggatgagcgtgtttttgaatttactgattaaaattcatgtcttatcttttggcttattaggggaaaataagcatctttgtgtgcaataaaaacaaagatgtgctatgaaaaaattattatcacttccccctaatctggtggaatgttttcatgatatagagaaagcggaccagacagagtggttttgtacttccgatcctataggtagtaagctaggatcaggcggggggactgcatggctgttggaggcttgttgtcagaaagtagctcctgacagcgattttcttacttggctgggaaaagaaaaacgtattttacttcatgcaggcgggcagagtcgtcgtttgcccggatatgcgccatccggcaaaattcttactcccattcctgtattccggtgggccagaggacaacggctgtcacaaaatctgctttccctccagctccctttatatgaacaaatcatggagaaagctccgtcttctcttcatacattgattgcaagtggagatgtttatatccgtgcgggccaaccgcttcagactattcctgatgcggatgtggtgtgttacggtttatgggtagatcctaatctggcaaaaaaccatggtgtttttgtttcttcacgggctactcccgataagcttgatttcatgcttcaaaaaccttcggtggaggaattggggaaattaatgcaaacccatctttttctgatggatatcggaatttggctgttaagtgaccgtgcggttagtctgttggtaaaacgatcttataaggaaggaaaactctcttattatgacatgtattctgatttcggacttacattgggagagcacccgcgtatgatggacgatgaacttaacaagctgagtgtggctattctgccgttgcccggaggggagttttatcattacggaaccagtcgtgaacttatttcttctacattggcagtacaaaatctggtaaacgaccagcgggagattatgcacaagaaggtaaaaccgcatccggccatgtttgttcaaaatgctgaggtaggttatcaacttacctcacaaaattcggaaatatggatagagaacagttatgtaggagcaggatggaatatccatcaccagaccatcataacaggggttcccgctaataattggaacctagaggttccgtccggtgtgtgtattgatgtggttccttttggagaatctggctatgtagcgcgtccatacggcttcaatgatactttcaagggagctttggctaaggaagaaacatattatcaaggaatgtctgtaggtgagtggtgtgctgtacgcggcatttcggtggaagaaatagaaaacggtcacgacttgcaggccgcgcgtttgtttccggtttgctcatctgtagaggaattgggagcagttatgcgctggatggtctctgaaccggcattacagcaaggaaaagaaatatggcaacgctgtcgtaagttatctgccgatgatatatctgcttattctaatctttatcgtctggcagaacagcgtgaagctttccggataaagaattggccggcattggcgcataattatgaacgaagtgtcttttatcagctaaatttggagaatgctgctggagaatttgctcggtatgatctgtcgttgcctgagcctttatcagaatcggctccgctgatgacacgtatcagtgataatatgttccgtgcccgggtgcagcagcttaaggggctggcttatcgggaatatgagaatgaggcttttcgtttgatgcgcgacggacttactgcttcggctttagccaagaggcagcaaccgcatttgtcagtgtactccgatcagattgtctgggggcgtagtccggtccgtattgatctggccggcggatggacggatactccaccttattgcttgaatgaaggggggaatgtggtgaatattgctattgagttgaacgggcagcctcctctacaagtttacgtgaaaccctgtcgggagtataagataattcttcgttctatagacttaggcgctatggaagtggttacaacttacggggaggtaagggatttcatgcaagtgggatccccattctctatacctaaagcggcattggtgctggcaggtttccagccgggcttttccaccgaatcgtatgtttcattggaagagcagttgaaggcgtttggctccggaatggaaatcactctgctttctgcgattcctgcgggctccggtctgggtacaagttctattcttgcatcaactgtgctgggggcaatctctgatttttgcggactgaactgggataagaacgagatatgtaaccgtacgcttattttggaacagttactgactaccggaggggggtggcaagatcaatacggaggtgtgcttcgtggagtgaaattattgcagactcatgcaggtatggatcagagtccgttagtgcgctggttgcccgattatttgtttacaggtggcgaatatcagaagtgccatttgctttattacacgggaattacccgtacagccaaaggaattttagctgaaatcgtgcgtagcatgttcctcaactccacagagcatttgtctatacttggcggtatgaaggggcatgctcttgacttgtacgaagccattcagcgtgggaatttcgatgaaatggggcgtttggttggtaaaagctggaagctgaaccaagcgttggatcccggcactaatcccgaggcagttgagactatcattcgccggattgatgattattgcctgggatataaattgccaggtgcggggggaggcggctatctttatatggtggctaaagatcctgaggctgctatacgtattcgaagtattcttactcagaacccacccaacagttgtgcccgtttcgttgatatggctttgtccgacaaaggcttgcaaattagccgaagctagttataactgaatagagttgggaaaccagccgggtgatattttctttagcaaactccggttccattgccttctccagggtgatggggccgggggctatagagaatatacctttgaatcccgctttgtttaattccggcaggttttctatactgcctgccagtacaataacgggaatatgttctttttgtgcttcctttagtattccgtatggtacttttcccatagctgtctgccggtctgcttttccctcgcccgtaataatgaggtctgctccttttattttttcggagaagtcgatggctttcaataataattctgttcccggttttagctctgcgttaaaaaaagccagtagtccaccacccatgcctccggctgcacctgcaccggggtagttcgtgatatcttttcctgtcgttttctttataacttcggctaatgattgcatgccttcatccagtctttgcaccatatttgaatcggctcctttttgttgtgcaaagatatatgccgctccgtcagggccgtagaaagggttggctacatcacatgctaccatgaagtgtgtttctcttagtgcgggatgaataccggatgtgtctatgtttgccacggcttccattatttggcctcctgtacctaaggtatgccctgatttgtctagaaagcggaaacctagtgcctgtagcattcctaatcctgcgtcattagtcgcgcttccgccaataccgattataaaatttctgcatcctttgtttaatgcgtcttttatcaattctcctgtaccaaaggttgttgtcagcataggatttctttgttcaataggtacgagaggtagtccgctgatggcagccatttctataatagctgttctgccattgccggacagaccgtaatgtgtttttgccattttcattagcggtccatgtgccgataaggttatatatttccctttagtggctgtgatgagtacgtccagtaaaccttcaccgccatcagcgatgggaataactgaagtgtggcaggaaggatttatgcttttgatacctttttcggcagcttttcctgcttctgctgaagttagacagcctttgaatgaatcgatggcgataattattttcttcattgtatatctttatatagtgcaaatctactgaaaacttttcttctttaaatagaacaggttgtcttttatttgtggattggaatatgtgtagcttgatggataaagtagatgttttttgcttttgtctgggtgtaagtattggttcttgaagttgatggtgtttccgaacaaccgtcgagatgtaagaaaatgattttttttcttctcggcatttttttcctacagtttttccccagtgtttgcggagtcagcacttttgagagctctgtggtttgtgtttcgtaacctgtccggtttttcttcgggcttgcttcttttccgtctttccttgttttccgtctgctgttttcgtataggttccttcctttttccgtccctatacgcgcgtgcgaatattataatgtgtgtgtctttttcctcccgtgtcctccgttataaaaacatgctttgtaacacatctgttattcagagtattacaaaaaagtttcaggaaatccgtataatttttccttcgtatgtttgctggtaatcgttaaaaggtctacctttgcatccgcaatcgagagagatgcggcacttcagacagtgtgtgactgacttggtgaaacaaacgtaggagagttttccttgacagtgtctgcacccagtatcttaccttagcggggctaagggagcgagaacggataagacctggggaggatggacgtcccgccttttatggaagtttcggaaaaaaaactttttcaaaaaaaaactttcgaaaacatttggtggttacgataaaatctcttacctttgcatccgctttcggaaacgatggtaaaatataaatgagagttctttgaaagatttaagataaacaaacaagtagtacaagccggtgcaccaatactttgtgtatgaattagttggctgattttgtaatatttaatgaatgtcccaagaataatttgatttttactataaaaaaggaagccatcttaatgacttccttttattataacctagctcctattctataattacttcttcaaatcgaatcccaacatcaaaccgtcataagatccggctacactattaatggtggcagcagtagaattcactttagaaacagtacctgtaatcgttttcaatactgacattaatttatccgcattaaagaccagactcatatcatttccggtcactgtgacatgagcaacagtttttactcccaattttcccttcatagtaatggtcttttccttatcatcgaacgtgtaagtgccactcattgtacgttttttcaatgtgtatgaataagttccatcttcattaaaagtatactcacagccactcatccctattctgtcatagacagtctgcatcttctcctccacttctttcgcagctacttctccaccggctttagccagtaaattttcactttcgaactggcattgcggacctacatatttccaagtacctataatagaagatgaagttgttgctttatcacctactaccgcttttgctacgccggtcaatatagatttcaaatcttgagcattggcattaaccaaaatggcaaacatagccaaacacatacataaacatttcaacaaagttttactattcatgttttattgattttaattgtttgcaaagataaacaataaacattacaaccaaagcaaataatcgaccaattggcttattttaccttctaataaaagagacgtaccgaaagttttccagtacgcctcaaacaatctttaccaaggtataacaaatacttattccaacttttcaagtataatttaaaatcaacagctaatcgttatatcaacgtttcagattcggattcttctcaacttccttcggaggataattatgataaatggaagcctcaccattccaaggaacagttacagacatattctcttccattttcaaatcttcctgaagagcataggtaaaagtcgtcttagtttcttcgtcgtagctataagtcaatgtaccggcaggaaccaatacttcatcctgagaaccactacggtagtcataactttctttgagacggttcatgcggaactcatcagaacgacgggttaccatagccaatacataaccagccacttcataaccgtgttcttcatatgctgcttctgccagttgttcagcactcatagcatccacagcagctacaaatgattcatcggaacaagcacgtgcacgtacctgctttagagcagatttagccaagctgagatcctttcctgcgcgtgccgcagattcggcataccaaagaagaacttctgaatagcggattagttgatgtcgtttgttaatacacatacctccccaaataggtttggtgtaatcgaaagcagccgatgcaggaagtcctgtcacagggtctttattgacggtaaacgccacaaacatcgggcgataatcggcaaatactgcattcgtaccattatagggctttccatccgtagttgcccaccagtcaaccaacactccattgtttaatagaatttgttttgaataaacagcatctttacgaggaccatcaggaaagtttttccaataacgccgctctgccaaaaaatccccccagccactccaaagttttcctgattgatgacaagatgaaagttgtgaatcccattcctgccaaccgccaaaattagaattgtaatctattccaaggagcgtctcattatgatggtttttaccataagagaaaacatccttccattcagaaagcaaagagtggtcataggtacccttattcacgccatccattacttccttagccttgtcagccgcatttgcataatactcggtcttattcaaagggtaacctgccatcgccatataaacagctgccaaagtcgcctttactgtctgatctgaaacgtaaatattctgtccttcaatggaacggttagcttccgtatatttagccggcaggttacaggcttcggcagcgttcaagtctgacacgatttgctcatatacttctgcaaccgtcgatagaggtgtcaaattgttgtctggcaaattatgaagattcataggcaacggaccaaaaacacgcaccaaattaaaataagcgaatgcacgccagtagtaaccctgaccaagagcaatattgatttcctcttgagaagtcatagcctttccagcattatcaatgattaaatttgctgccttgatgatcgtataaaaacgactccaagttccttcaagaccttttgtgtcagaaggagattcaaaggcatctgcagaaagataagcacccttgtttgatcccgtagttgaggttacgtcatctccctggcattgcacaatcatcggattagagttacattgggatgcctgtactttggcatatagggcataaacactcatatccagttcgttttgattggaaaagaaattttcaggggttaattttcctttcgggttttcagtcagaaaatcactgcaagaaggcattgccaacatagatgctgcaataaagcagcctaatactattttatttttcataattgtcaatcatttagaagttcatacgtacaccaaaagtaaaagttctaggagtaggataagtacccgtatcaataccatttgcacgatcaccatagtcacttgaaaaagagtaaccagcaggattggatcccttgtaactggaaatagtgaagagattctgaatactgaaactgagccgcaggtcggctattttggtcatgcttttcggaaaatcgtaagctaaagtcacattctcgcaacggaaataatctgcattctccacccatttggtcgaattgcccagatattgattgttttcaacacggggatcgggcatcgtcttacctatttccttcaaaaaatccgcatcagtaaacattcgtgaattaccaatcatagagttcatggcaaaacggagggcgttcaaacgtttggcaccgaaagatgaattgaaaaatgcattcaagctccagtttttataacgcagcgaattgttccatcccagtgtaaagtcgggacttgctttaccgagcacaacacgatcatctgtagacggattacgtgttatttcatcattggcagtataaaaagtgtcatatccttcattgtctattcctgcccaacgataaccaaagaaagtaccgatcgcttcaccttccttaataatagtacaatcagtgataatggactggaaagaaccaccataaataatgggttcctgagcagtcagttttgttaccttatttttcaagtaagtaccattaagtgtggttgaccaactccaatccttgctttgaacgatatttgcagtaagagcaatatcaaaaccttggttggaaacctcaccggcattaatcaaataagaagttccacccaaataatcagccaacttggttgaaagaagtgcatcagatgtctttttattgaaataatccacactcaagtcaatacgattatcaaaaaagcccaagtcgaaacccacatcaaactgctttgtcttttcccattttatatcaggagttgcaagcgtattggcccaataaccggttactcctgaagaattaccgaaataagtggtagtcgtattaaggattgcaagagttgaataaggatcaatatcctgattacctataacaccataactggcacgtatcttcaaattactgataaggtcacgggtactttccataaacgattcattggaagcagtccatgcaacggctacagaagggaaatacccccacttatcattggtgaaacggctggaaccatcggctcgaaacgtaccagtcagcatatagcgattatcgtaattatagataacacgtcctacccctgaaagcaatgcccaatccgaatagccgttggttgcatcacgtgtgacagcattcttcacatcccaccagcctactgattcagcttgaagtgaagaaccggaaatccccatattacgaatcgtactttttgttgcttcccaaacccctgttacggtcaaataatgtttgtcattccaggtatgattataggtgatgttatttgaggactgaagcaacatccgctgtaaattactgttacccatgctattctttcctgcaccgtttacagattgtggtgtgaagctataggaagtattattataataatcaaccccattgctgcttgtaaaagtcaagcctttgataatattgaatttaagatcaatatgtccgctgaacacatcgcgacggcgctcactttcgctagctgcgattataccataagcattagcctgaatcgtaccataagggtcccaattatagtaaccatttttatctgtcatagtcatggtcggagaggaattaaaggctatccacaagggattataacctgacatctccaatcccccaatacccttaccaacaccatgagatgcgtttaaatcgacagtaacatccagccatttagccatagagatcttaatgttggctttagccgaataacgttcataactatttttgtcaatgacaccttcatcacccatatagttagcggaaacatacgtttgagttccttcagagccttttgaaaagacaagcttgtagttttgagtcacacctgtacggaacatctgatccgtccaatcaataccgggattactgccatccaaataatcagaaacctcactcgcactaatacccgcataatcaacaagtgcttgggcataagttttggtatccatcatcttgggaagattggtagcctgagagattcctaccgaggcgtcaaaagtgatgttagtctgccctttcacaccactcttggttgtaatgataacaacaccgttggcgccacgtgaaccatagatagcagtggaggaagcgtccttcagaatttgcatactttgaatatcttccggatttataccttcaagacccgactcacgaaccataccatctacgacataaaggggatcattacttttattaatggaattggtaccacgaatgcgaatctttaccgaaccacccggaacaccatcactgaccacattcacacctgcaacacgcccttgaagcgcatcacttacttgagtaatgggctggtccttaaaattcctgctatccaaaacggaaaccgaacctgccaagtcagccttacgtactgtaccataacccaccacaaccacttcatccaaagtctcagtatcttcctgtaaggttatagtcaaattcttttgcccttttaccaatatattttgagcaatatatccgatataagagatcttcaacgtagcattgggcttcacattcaatgtaaacttaccttcaaaatcggagataaccccatttacggttcctgcctctacaatgtttacaccgactaatggttctccactcgcatcaataactgtaccagttacactaattgtctgttgctgtactattactacgttgtcactcatatttccggcaattgcatacccggcattacccgacatcaatatacccatactcattggtacagctttcaaaattggattgtaccacgcagactcgaacagcctacctaatggcaataattttttcctcataaaattcttaaatcatttaaggttaaactaagtttgatgatttgcagcaaaattaactatatcccccctcaagaggggtccgtgtgcgtataaaacaaatcaactatcgtctaaattttaaaaagtaatacgataaaaatcaaaaatcatataaattagttccttatttatctaaaaaaaagatttgtgaagcttttctctatcaggaaaaaagtttaattttgttctaaaatcataaagagatgtaccgaattctacttatactatatattatatggggaggggtgtcaattgcaagtggacaagactttaattactctttcacccaactttccactaatcaaggattatcacaagcttctgttacctccgttacgatggatcagaaaggaagactatggataggtactcagagcggcttgaactattatttccagcagcaactaaaaaccttcattcaccatgaaagtgattccctatccttacctaacaattacatcaatcacatagtagaagattcattaggtaccatctgggtggccacctccaaagagatggttttatataacagcgataatcataatttcacgcctactggatacaattgtatttattcttccctctgcattgaaggaggtatattgtttggaagtgagaatatcattttccgctataattataaaagccggaccatggacagcatctatatttgccagaagaagaatttggatatatccgaataccggatacaaaaaatggttcagttgaaaaaaaataaaatactgatagggaccaaagaacaaggtatctatctctatgattgttgcacgcaacagctcacccgtttcacatcagatatccatcatctactgatttcgctctatgtggtatcagacaagtatgtatatgcctctttttacggcaatgggatttattgctacaaccaagatggcaagatagtaaaatcttatacatcaaagacttcttctttaaacaataactatgtgctagacatcatcgaacataaaggacaattatggattgctacagacggaggaggtatcaatatacttgacatgaactccgaccaaatcaaagtaatgtgtcatgtggctggagacaacttctctttgcctgtcaattctattgtcttattatacgaggacagaaacgggaacttatgggcaggtagtgtccgagggggtatctttaacattaagaaaacctatataagaacttataaagatgtagccctgaacaactccaacggtttaagcgataagtctatcatttccttatatgaagatgacgatgacaaattatggattggtacagatggaggaggtattaatctatatgatccacacaccgatcagtttacccattttccttcgacctacggagacaaagtggcctctatcgccaaaatatctgaaaaggagttgatggtatctctttacacaaagggtatatttattttcaataaaataaccggcacttaccgcccctttaccattgttgatgaaggtacaaattacaaagaatgcttctatggctatcttccattggcccatcaagtagccaatgataaaatttacattatcagttaccgtccatgggtataccatccattaagtggaaaattctctttaatgcccaccaacaatctgaaaaatacggatgcattgcgtctcgtctattccaatgagcatttctcattattaaaacgtgtcaatcaaatattttatgtacctcaagaaaacgacagtatcagccttttatgtgaaatagacccagaggagacaattacagctcttgcctatcaggatagtactatttggataggtacggaccgaggtctgggatgttatgatatgatacacaaaaaattccaccatatacataccaactattttgaaaaaatatctttcctcattggcgacaaaaaaggaagattatggatttgtgcacacaacaaactattttcttatctgattaaagaaaagaaattcacattgtggaacagttctgacggatttctgcctaacgacatactagctgcccactacacactatccaatcccaattttgtttatttgggaggtgcggaagggctggtgaaaatcaataccaatattcctcagtctgaaacgcaaatacctcagataagtctggcagatattaaatttaacggatgttcttatctgaaacaaatgaagaatcagacacttcatattccatggaattacaattcattgaccattcatatatgtgtaaaaaatgaagatatcttccaaaagaacttgctcagatataccatatcaggcagaggaaaacaaacggtcgaaagtttcgactccgaactctctttatcttccctgtcaccaggtaaatataaaatctgggtatcaagcagcaccaaagatggtgaatacactactcctgtacccataatcaacattgtcatcactccaccctggtataaaagtagttggtttttctcgatatgtactcttttatttattcttctttccattaaaatagctctttgggtatttcataagaaaaagaaggaaatgagagatgaaatgggcgattttgtccaaaccgtcctctataatgtactgggaaataaagaagaaaatacaaaagagaaagacttggaagaaataacagatacttcatatcctcaagcaatggaagcaactccgctcagcagtgctgacgcagatttcataaaaaaactggatcaaattatcaatgagaatctatcaagtgaaaaactatctatcaagtacctgacagataccatggccatgagccgtgcatctttatataataaagtaaagcaaattaccggattaggggtcaatgaatatatcaacagactacgcatagaacgctctgtataccttttagcaaataccaatctgagcattagcgagatttcctatgaagtaggtttttcttatccgcgctatttcagtacttcatttaaacagatgaaaggggttacaccttcacaattcaaggagaaaaacaaaaatagcggacacatataaactgttagagcaaataaggcctgccatttattattttggacgaaataaagaactgacattcagattctttacttcgtccaacaggtcataaaatgataccaatattaacaagccttgaaactcatatccagccccttcacggagtgagtcagcgcaccgaaagaaatgaaatccactcctgcctgcgcataaggtaacatggtatcgtaagtaatacctccggaagattcggtttcgcaacgtccacctactatttctacagccttacgagtatcttcgggtgtaaagttatcgaacatgatacggtctaccccttctgccaatgcctgattcaattcatcaaagttgcgtacttccaattcaattttcagatccttacctttcgccttgcaatactcttttgcgcgagatactgcattgtgtatgccgcctgcaaagtctacatgattgtctttcagcaggatcatatcaaacaaaccgatacggtgattacatcctcctcctatctttacagccatcttctccatgatacgcatacccggagttgtcttacgggtatcaagtacacgagttttcgtaccttccagtttcttcacatatttattggtcatagtagcaatgccactcatgcgttgcatgatattcagcatcaagcgttctgtctgaagaagtgactgaactttaccttccaccaccatagccacatcacccggtttcacgtgagttccatcttgaatgaacacctccaccttcattgtgggatcaaaacggcgaaatacttctttagccacttcaatgcctgccaaaataccttcttccttaatcaacaactttgattttcccattgcatctgcgggaatacatgacaaggtagtatgatccccatcacctatatcttcagcaaaagacaggtctatcagtctgtctattaagtcttttactactaattcgtccataatgttatcgtttttttatgaattgataggcaaaggtagagattttccgtatttttgcaaagtaaaccagaaaagaacgtatgaaatttacattattagtagtaggacgcactgtcgaaaaacattatatcaccgctatcaatgattatgtggaacgtaccaggcacttcatttctttcgatatggaagtcatccccgaactcaagaacaccaaaaacctgagtatggagcaacaaaaagagaaggaaggagaactaattctgaaagctttgttgccgggcgatgtagtggttttattggatgaacatggaaaagaattccgttccgtagaatttgccaactggatagaacgcaaaatgcacactgtaaacaaacggttagtattcatcattgggggaccatacggatttgcacccaaaatatatgatgcagcccaagaaaagatctcattatccaagatgaccttctcacatcaaatgatacgccttattttcgtagaacagctataccgggcgatgactatattgaataacggtccttatcatcatgaatagaaatatatagcggttagtgattaacacctgcggcataatagcgcagtccattcatcactaaccactaattctctccctattttccaatttcaaagtccacacacactggtaaatggtcgctatagccaccatgatatttctttccccagtaggtacgtgatgggatatcaccaccatatttttcatcctcttccaataggaacggatattttaaaatctgtgccttatcatatgaagtgcgcatactatcatgcccttgtaacaaaaaaccggaaacaatcagctgatcaagtacgccccactcacctcgataacgataggttccctccttacgcccgtccatcagattatacagtttcttagcctgtacttcacctttcggagccacggcacccaatactttagctatcgaattattagtgggataatcattaaaatcacccattatcatcacattgggatgctggcgaaggtttatgatggaatctgccgctatgttcaatatctgtgcagtgaaaagacgataaggctcacttttttcctcaccaccggcacgagacggcatatggcacacaaacacgtccaaagtatcacctgatgctacctgccccatcacatgaaggatatcacgtgtagggcggcgttccatctccttataaggaacagaaaggctgtttttgcccagcaacttaaaacttcctcgctgataaagcaacgccacatcaataccacgctcatcaggagaatcagttatgacataacgataacctgcctcgcgtaatggcgagttttctgtcagatctttcaagcaatgatcattttccacttcacaaagccccaccaaatcgggaacattttcctcaccggtggcaataataaccttagctatcttagccaatttatcatgatagcgcgcttgtgtccatcctttcggagcatctggcaaaaattcataatcatttttcaacgtgtcgtgctgacaatcgaacaaattctctacattatagaacattacccgaaacggttcctgtgcatacgtcacccctaccaggtagcacaaacaaagaaataaaattgttttcttcatataaattattttgtcggtatattaaccaatacatccagcaaatgacgccagaatttatctacagtaggtatcagcatacgctcatcaggtgaatgaacaccacgcagagtaggtccaaaagaaaccatatccagtgacggatatttctcaaggaacaaaccacactccaatccggcatgaattgcctttactttaggttccacaccaaaaagttttttatagctatctaccgcaactttcaaaactggagaatccgtattcggtttccaccctggatagccttcaccagttgttacttcagcacctcccaaaagaaaagcagaacggatcatctcggacatatccttgcgtgatgaaagaatggagctgcgctggctagtcactattttaatcttgtttccctctacctgtttgatggaagcaagattagacgaagtttctactaatcccggaatatcctgactcatggcatacactccattgtgcacagcgtaaacagctctcagaaggtgtccggcagtagtcatatctatcgcttccttacaaggggattcagaagagagttcggttctcaagttcggttctgtcgcagcatattcattctccagttctgcggtatagatattcaaatctacacgaaccgattccttatccttcataggtaccgcacataatgcctgtgcctcacgaggtatggcattatgcaggtttccgccatcaatctcacataaatataaaatatatttagaagccaactgggtcagaaaacgattcagcagcttattggcattcgctctacctttattaatatcatcaccggagtgcccaccagtcaatcccttgaccgccacacggaaatagaaataatcctgtggggcagaaacaggctgataagtaaattccgctgtagtatttgccccaccggcacagccgataaataattctccttcatcttccgagtccaaattaatcagaatatcaccagtcataaaccctggcttcaatgcaaaagcacctgtcaatccagtttcttcatccaccgtgaaaagacactccagcggaccatgctctatatcagtagcagccaatatagctaattctgtcgccacaccgataccattatccgcccccaatgtagtacctttggctttcaaccattcaccgtccaccactgtttcaataggatcaattagaaaatcatgctccacatcactgtttttttcacaaaccatatctatatgagactgcaaaatcacagttttcaaattctccttacccggagtggcaggctttttaattaatacattgcctacttcgtctgtcttggtttccaaaccatgttctctaccgaaggctttcaaataagcaattattttctcctctcttttagagggacggggtaccttacatatctcttcaaaataataaaagacagatgcaggctttaaattcttttcattcataatcatgtcgtttaggcaaattcagtttccaaatttgcaaaaaatagttaaataattctcttaaataggacacttcctcttttttaatgaaaaaagagaaagctaaatcattgcaaaattctatatttgctatgcaaatttagtccgcagacacgaaatgcttcaataaatttggcatttcccttgccttacactaactttgcaccacaaaaataatagaaatgcttgatactatccttataactgtgttaatagttgctatctgtatagcattattgtctatcggaatctttctaaaaggaaagtttccaaacacgcatgtaagcggtaataaggcactccgtaaaaaaggaataggctgtgtgcaatcacaagatcgtgaagcacgcaaacctaataaaaatgccatagccgaaattgaaaagcaaagcaaaacggataataattaataaacaatacgtgaaaaagattatgaaaagaacaaatttcatcctgaatggatttctagcgctagccatcgtgttagtgttcgcacaatgtagcgacaaaaacaacaacgctgcaacttcttccgctgctccggctgccggcgttgcaggttcctcaaacatgaaaatagcttatgtggaaatcgattcactgttgactaagtacaatttctggaatgacttaaatgaagtgatgatacagaaagaagaaaatatccgcactactttaaatgaaaaagcaaagaagctggatgctgatgctaaagaattccaacgcaaactggaaaataatggctttgctacacgtgaacgtgctgaacaagaacagatgagactgatgaagcaacaacaagaactgcaggcactccaacagaaactaagcgacgagctagcttctgaaaaccaaaagaacagcttgcagttacgtgattctatcaattcattcttgaaaatttataatcagaacaaaggatatgatctgattatcagcaatacaggatttgacaacttgctatacgctaatccggcatacaacatcacacaagaaatcattgacggactgaatgcacgttatactccctcttctgtaaaaaaataatagttcatcaaccttatatatgcaaagccggaacagtctactgttccggctttacttttaaacaaaaagcaccctataaacgtttttattataataaaaataacgaaaggagaacattatggaaagatttgaagatttaatcacctcaaacatccctgtattagttgatttttttgctgaatggtgcggaccttgcaaagccatgaaacctattttagaagaattaaaaggaataaaaggggaaaaagtaagaattgtcaaggtagatgtagacaaacataaagaaattgctgcatactatcagattcagtcagttcccacactaatgatttttaaaaacggtaagcaattgtggcgacaaagcggtgtaatgcgtgccaatgatttaagcactattctagcccaatatgagtaaaatatgaagaaaacaatcacatgtattctattaactgccggattaacgggatatctcagtgcccaaactcctgtccaggataagtcagataaaaattcaggaaaagtcatacgtatggacaaacaaatgttcttggataatatatttgactacacttccggttccactaactggaaatacaaaggagagaaaccggcagttattgatttttacgccacatggtgtggtccctgccgtatggttgcccctctgctaaaaagtctggccaaagaatacaaagatcgaattgcattttacaaagtagatacagacaaacaaaaagaattatctgccgttatgggaatacagtcactgcccaccatcatctttatccccaaaacgggacagccacaaatcattataggagcagccaataaagctactttcaggaaagccattgaagaagtgttactgaaagaatgagaaacaagccctacacatctctaatctaaatataaccaataaaagagagggggcaataataattgctccccctctctccatttatactatagcaaattgtatattatttcttgaaatatctgttgtacaaaccttcaaaacctttgccgtgacgagcttcgtccttagccatttcgtgaactgtatcgtgaatagcatccaagttcaaagcttttgcacgagtagcaatgcgtttcttgtcagcacaagcacctgactcagcattcattctcttttccaagttagtctttgtatcccacacacagtcacccagcaactcagcaaacttagcagcatgttctgcttcttcccaagcataacgtttgaaagcttcagcaacttcaggataaccttcgcggtctgcctgacggctcattgccaaatacataccaacttctgtacattcacccatgaaatggttgttcaaatccttaatcatttcttcatcacaaccttttgctacgccgataacgtgttggtctgcaaattccaatccaccttctgtttctaccatttcgttaaacttagaagcaggcgctttacacaacggacatttttcaggagctgcatcaccttcatgaatataaccacaaactgtacaaataaactttttcataatttctttttttattagttagtcaatattttatttattagttaatcatctactctctatcctttttaacttctttcttaatcttctttagaacaagcagggcatatacctttataatattggtgaatttcatccactttgaatccattcatatcaatttgctctacttttttcacttcattactatagggcaaatcgaatattttaccacatttcttgcaaaggaaatgagcatgcagggaagtatcaccgtcgaaacacgcattcttttcatcaattgtaagcattaaagctgctccatgctcgacaaagagtttcagtgtattatacactgtagtcttggataaggttggaatatccttacatagcgccaaataaatctcatcgatagaaggatgagttttatgagccaacaaataatccataatagctatgcgctgtacggacggcttaatgttataactgataagataatcgtaactcttcatatattccctttttgtaactattacaattttatttcatgtgcaaagatagatagttattcgcaacaaacaaataaatcacgcacttttttttattttttttatttagaggtataaatcgggaaagaatgattaattttgcaggtatatataataataggtataatatgaaatacggttttgtaagagtggcggctgccattccgatagtgaaagtggctgactgcaaatttaatgcacaacagattgaaactcaaattgccatagcagacgggaaaggagtacaaattatcattttccccgaactaagtattacagggtatacttgcgccgacttgttcggtcagtctttactgttggaagaagcagaaatggctttaatgcagattatgaataatacccgacaaatggatatcatctctattatagggatgcctgtggttatgaattccacgctgctgaacagtgctgttgttttccaaaaagggaaaatactgggtattgttcctaaaacatatttacctaattataaagagttctatgaacaacgctggtttacctctgctctgaaccacccggatgccaatgtacgcctctgcggacaaaatgtaccggtcagcgccaacctgcttttcgacactccggaaacttgctttggcattgaaatctgcgaagacatgtgggcccccattccgcccagttccgcattagcactgaaaggagcggaaatcattttcaacatgtctgccgacaatgaaggaataagcaagcataattatgtccgttcattagtcagtcaacaatcagcacgctgtctggcaggatatgtattcagttcatccggtttcggcgaatcaaccacagacgttgtttttgcaggcaacggactgatatatgaaaacggcacgttacttgccgagtctgaacgtttctcattcaaggaacaattggtcatcagtgaaatagacgtggagcgtcttcgtggtgaacggttgaccaataccacttttgccgccaatatcggcaactgcccgggacgtcccgccatccacatcagtacagaatttgtcaacacacgcgatcttagtctgacgcgcagtatagaagctcatccttttgttcctcaaggcaaagaattggatgaacgctgtgaagaaatcttcgctatccaaatagcaggactagccaaacgtctggtacacactcactgcaagactgtagtagtcggtatttccggtggtctggattccaccttggcacttttggtctgtgccaagactttcgataaattggatctgccacgaaaaggtatcatcggcatcaccatgcctggtttcggtactaccgaccgtacttataacaatgctctccatctgatggcttcactaggtgttaccattaaagaaatcagcataaaggaatcctgcatccaacactttaacgatataaaccacgacatgaccgtacacgatgtaacctacgaaaacagccaggcacgcgaacggactcaaattctgatggatgttgccaaccaactgggcggtcttgtcattggtacgggagacctttcagaacttgccctaggctgggccacctacaatggcgaccatatgtctatgtacggagtcaatggaagcattcccaaaacactggtcaaatacctggtaaattgggtggctttgaatggcatggataatgaatcacgtattaccctgctcgatattgtagacactcctatcagtcccgaactgattcctgctgatgaaaacggcaatataaaacaaaagacagaagatttggtaggaccatacgaactgcatgatttcttcctttatcaattcctacgtttcggttttcgtcccgccaagatattcttcctggcaagtatcgcttttcgtgatacatacgatgaggaaacaatcaaaaaatggcttactatattctgccgccgtttctttcaacaacaattcaaacgctcttgcctgcccgatggtcccaaagtgggatctgtatcactcagtccccgaggtgactggcgtatgccgagcgatgccagtgcagcttcatggctgaaagaatgcgaagagctataaaccacataaaaaagtaagtcggcttcaaagacaaagtaacttaacttactcgcccaactaagttaagttactttgtctttgaagccgacttaaatacatcccttgcttgagggtacttcaaaatggtaaatatctcttcgcacagccatctttatggcacgagccaaagctttgaaaataccttctattttatgatgctcattctgcccctcggctttgatatttaaattcatacgagctgcatcactcaatgatttaaaaaaatgaagaaacatctcggtaggcatctcccctattttctcccgatgaaactcagcatcccataccaaccatgctctaccgccaaaatccaaagctacccgacaaagacaatcatccatgggcaagcaatatccgtaacgctcaatgccacgcttgctgcccaatgcccgataaatacattcacccaaagcaatggcggtatcttcaatagtatgatgttcgtccacttccaaatcaccttttactttaatggtcaggtcaataccaccatgctttccaatctgttccaacatgtgatcaaaaaaaccaatacctgtggaaatatcacattttccgctgccatctaaatttaaactgatataaatatccgtttccttcgtagtacgacggacctccgctatacgttctccggcaaaaaggaattcagcgaccttatcccaatccgtagtcgccaatacacagtaggattccaagttcttttccttcagaatatccatattttcttgcaacaaaatagccttacagcccatatttttagccagttccacatcggtagcgcgatcaccaataacaaaactgttagccaaatcataatcaccggtaagatattttcccatcattcctgttccaggcttacgggtaaacacatggtcttccggaaaactgcggtctatcaagatatcatcaaaaatgatgccttccccctccaatgtcttcaacaccaggttgtgcaccggccaaaaggtatcctcaggaaaagaagaagtaccgagaccgtcttgattggtaaccatcacaaattcaaagtcgagtttgctgcggataaatcccaaattacgaaataccttaggataaaactccaatttatggaaagaatccaattggtagtcaaccggtggctctataaccaacgtaccgtcacgatctataaacaacgctttcttcatacttcaacattcataattcttcaatgcttccaacaacatatcattctccggacgtgtaccaatagtcacacgcaaacaatcacgacataaagaaatactggtacggttacgcactatgatacctttacctaccaaataattatatattttcttggcatctgtcactttagctagaaagaaattggcatccgtaggatagattttctcacaacaaggcagttctacaaattcattgaccaaacgcgtccgttcttccaataacgactttacccaacgttctacctcataatgccggtgcaacatcataacagcctctttctgtgtcagcagattcacattatacggatatttaatcttactgaaaatagagatgatttctttagacgcaaaggccatgcccaaacgaatggcagcacatccccatgccttagaaaaagtctgaaagacaatcaaattaggatatttatctaaatcggcaaggaaagacggcgcatcagaaaaatcggaataggcctcgtctataatcaccaatccctgaaaagtatccagtaatttttccatttccctacgatccaggttattaccggtaggattattgggcgagcaaagaaaaaccagtttggtgtgatcgtctgttgccgccaatagtttatcggcactgaactgatagttttcatccaataacaccttgcgatattctacatcgttgacatcggcacacacctgatacataccataagtagggtcaatagccactacattatccacccccggaatacagaacgcgcgatacaccaagtcaatagcctcatcactgccgtttcccagaaagatcgtatcggggtctacctttttaataggagctatcatattcttcaattcccgctgcataggatcaggataacggttattaggtgtattgtacgggttctcattggcatccagaaaaacagatgcctccgctccattatattcgtcacgtgccgatgaatagggtttcaaagcccaaatattcgggcgcgtcaattctttcaaatctttcatctttatactgtttttaatcttacggttactgcattcttatgcgcacccagttgttcattagccgccatcacctcaatagcaggaccgatattctgaataccctcgccattaatctcctgaaaagtgattttacggataaaactatccagactcaccccactatacgctttggcataaccattggtaggtaaagtatgattggttccggatgcataatcaccggcactctccggagtaagtgaacctagaaatacagatccggcattgacaatacgctctgcctgttccatataatccctggtctcgataatcaaatgctcgggagcatattcattcgtcagagcaattgcctcatccatatccctcaccaaaatcaatttgctgcttgccaacgacttttcggctatttcccatctgggaagcaaagccaactggcgttgtacctcatactccacctccttcattaatttctcagaagtagttatcagcatggcctgactatcaactccatgttccgcctgtgaaagcaaatcggctgccacaaatacaggattagccgtctcgtcggccagcacttcgacttcagaaggaccggcaggcatatctatcgcaacatcccgcaaagaaacctgctgcttggcagccgttacatattggttacccggaccgaaaattttataaaccttaggcacactttccgttccgtatgccatagcagcgatggcctgcacccctcctgctttgaatattttatttaccccggccagttttgccgcatacaagatagcaggatgaacctttccttctttatcaggaggagtacaaagtacgatttccttgcaacctgcaatctgtgccggagtagccaacatcaatacggtagaaaataaaggcgccgtgcctccgggaatatacaagcccaccttttcaatagcaaccgccttctgccaacaagttaccccgggtacggtctgcacctttttcccttcaaaccgctgagaactatgaaaagtatgaatatttttctgtgccagcatgatagctgccttcaattcaatgggtacctccttttccgcttcagcaatttccgtttcagtaacccccagtgagtccagtttcaccttatcaaaacgttcttcatattccctcaccgctttatctccttccgtcttcactttatccagcacttctttaaccgtattgcgcagcgtgtctgtattcaataccggacgacggagaatttccatccagtctttcttttcaggatatattattttcttcatacatgtattcttttataagtttacaaatctcgcctgacgtatggaccggctataatatcattttctcaatgggcaataccaaaataccttccgctcccaatgctttcagttttccgatgatctcccaaaaacgcttctcgtcaagcactgtatgtaccgaactccatccttcttgtgccaatggcatcacagtaggactcttcatacccggcagcacttcgataatttctttcaaacgctctgtcggagcattcatcaagacatatttcttgtcttcggcagctttcaccgcttcaatacggaacaagagttcgttcagaatctctttcttctcctcagacatattcttattgcctatcagcaacgcctcacttttcataaccacttccacttccttcaagctattgcttaccaaagtagatcccgaactgacaatatcaaaaatagcatcagccaaactgattcccggagcaatctctaccgaaccggtaatgacatgaatatcagaatgaatgccattccgatccatgaaatctttcaaaatgccgggataagaagtcgcaatcttacgtccttcaaaccaagacaaacccggatagtccacatctttaggtatagccaatgacaaacggcacttgctgaaccccaaacgtttaatcacctcagcgtcctcttttctctctacaaactcattctcgcctacgatccctaaatcagccactccaccagccaccgactgaggaatatcatcatcgcgaagaaaaagaacttcgatcggaaaattagacgactgtactaaaagaattcttttagaagtggagattttaatatctgcctcttgtaataatgccattgtctcttcaaacaaacggccttttgactgtactgcaattctaagcatgattctatctgtttttaattattaaccggcaataaaaaaggcttaccgttttcggcaagccctatatcattatactacaatatcaccttagcccaccgaattattcgttaggaaaatgatgatgatgtgtagcagttctaaccatagtcttttctttttacttgcgacaaaaataaagtttatatttaatatcagcaaataattatcgcaaaaactttgttttttctttcaaattaaaggtattatctcatcttgctccacctcgcagttcaagaaatgcatttcttcctttgccttctcttgagaaaaagtgaaataagtgcacagcgccttggtgcaaagttcctccttattattataaatagccgcttctacaaatacgatattgcgctttctctcctttatggaagccttcaatacgatatgcgaatcgttggtattaacaggtttcatatagcgggtttccattttggacgtaacaccggtagtctgtagtttacgcaaaaccacccatgcacaaatctcatccagcagcaccgcctgaataccgccatgcaacgtatcaatccatccctgaaactgtggctgaggtttccatatactaattacctcatccccatcctcataaaattccatcttcactccggcttcattgttgggagcacagccaaagcaattatatccttccatccctttccagggattgattatctttttcataggctatcttttagaattcataatccacacaagcacgatcagccttaacctccttcaaaaggccggctgcagctacatgatccggatgaacggcataggcattgacatctgccagcgtatcgaattcactatccagacaaatatcccatttttcagcagaattggcattcagtcccacaaatatatgacggataaaacctatcttggccggcaaagcttcaatagccgctttaaaatcattcatcactttcaatttttcttcctgtgaaagagtttctttcaatttaaataaaacaatgtgcttaaccatacttgatattttaattaattatcctacttttgtaatcgacacagggctaaagtatttaacctgatgcaaaagtaacagttttgttttaaaatacattctattattatgataattattggtatagccggcggaaccggttcaggaaagaccactgtagttagaaaaatcatagagagcctgcccccaggttccgttgcagtcattccacaagattcatattataacgatcagtcatccattcccttggaaatacgtaaacaaaccaatttcgaccatcccgatgcttttgactggccgctctttgaacaacagattgccgacctgcgcaaagggcatcccattgagcagcccacctattcttatctagtatgtacacgcctgcccgaaacagttcgtgtagagccaaaggaagtcatcattgtggaaggtatcatgagtctctatgataaagagttacgagacttgatggacttaaagatttttgtggatgccgaacccgacgaacgtttgctgcgtgtgattacccgcgacatggtggaacgcggccaccccttggaaatgctgatagacaaataccggaacattctgaaaccgatgcatgacgaattcatagagcctaccaagcaatatgccgatattattatccccaatggaggcaacaaccaaaaggccattgaaatccttaaactatatattgaaaagattttaggaagatgaaaaatgtctggctattagttcttgcctgtatatgcatgacagcgtgccgcaaccggcaacaatctgccgaagtgacaaattatgatttgccgcaaataaaagacagcggagaattagtagtcctgacactgaacagttccacttcttatttcgactatcggggcgagcctatgggattccagtatgagctggccgatcagtttgcccgttcattgaatgtaaaactgaaaataaaagtagcacagaatgcacgtgacctggtccataaactattacaaggagaaggagacctgatagcctataatctgcctgtcaccaaagagttcaaagacagtgtagagttttgcggggaagatatcatcactcatcaggtattggtacaacgtaatactactcaaaaaaagaagaaagcactgaataatgtgacagaattaatcgggaaagaggtctatgtaaaaccaggaaagtatctggaacgtctcatcaatctggataaagaactgggtggcggtatattgatacacgaagtcgataatgacagcatcaccaccgaggatttaatcatgcaggtttccaatggtgagatagattatgccatctgtgataacgaccttgccaaattaaacaagacttattaccccaatctgaatattgacctggctgtcagttttgaccaacgtgcctcatgggccgtacgtaagacctcaccgctactaggtgaagctgctactaaatggcatcaggaaaatatgacttctcctgcctatcaggccagtagcaagcgttattttgaaataagcaaacggacacctcacggttccatcttgtccatcaaagacggaaagatttcacacttcgatactctattcaagaaatatgccaaagatatagattgggattggcgtattttagcttccctggcctatacggaatcaaactttgatacaacagccgtatcatgggcaggcgcgaaaggattaatgcagctcatgccccggacggcgcgtgctatgggagttcctcccggtaaagaacagaatccggaagagagtataaaggccgccgtgaaatatatcgctgccacttcccgttccttcaacgcaataaaagatgaaaacgaacggatgaaatttgtcttggcggcttataacgccggaataggacacgtactggatgccatagcactggctgaaaaatacggcaagaataaatatgtatgggacaacagcgtagataactatattctgcttaaaagtaatgaagaatatttcaatgatccggtttgtaagaatggatacttccgaggggtggaaacctacaatttcgttaaggaagtaatgagcagaggggaagtgtataaaaagaaaatcaaagactgacagccactccttttattatttcaggtagactttaaaaaacactccgccggaaaagtaacggcagcggttgaactctatcacgacattgatataatctttccaaaagctgtattcagcacctatattcattgtacgggcgtcatattcagccataaggttcagtttattaacggctttcatcaaaggctgattgccgagtaattgaaagcggaaattagcacctatggcaggaccattcaaatgataatctgtccgtttgttatagacgtatgccaaatggatacctaactctcctgtatttctaatagacagatgttttgtaacagccagataataccgctgccaatgaccgtttccggatgcactaccagtcataccgataccataatccttttcagaagtcctgtcattggtaccgggatcgttcgctcctaacacaatctgaggagtccattccttccaccagccttctttccaaaggcgcaacctgcccgagaattgacgatcctgattgcaatatttgccccagactgattccggataatacgtactgccataaggagccttatgcaaagtacaggtatatcctacttccaaccaaggaaaaatggttatattaataaaataattacccgtatcataactccaatgccccggtgtcgcttccgtatccagaaaagcgcagccaaacataaaagtcttgtcacgctgcatctcccctgtcggcatgtgaagcaaacctgtcgttccatacacaaactgggctctcaaagcagacggacacaacagaagcaccatcagcccgaccaatgaaagtgttctcattttttcagattttcataaacatcagccacccggagagctattccatcccatccatacttttccatatcgtaatgtacctgtttaaaatccccatctattatttcctgtaatctatcagccagctgctctatattaccggtttcaaaataacagctggcatccagccccatttctttattggcgggaatatcactcacaatgacaggcaaccggtaactcatggcttccaacagagcgataggaagcccctcatgcgacgaaggcaacacataacaacgggcgtttgtcaaaagtgaatgtagttttttccctttcacgaatccggtcagtatcaccccgttttccctcgcttcccttttcaatgcacgcgaatattcatcctcaaaatccgtatctccggctaacaccagccgacatccttttttatccaccctccgaaaagcctccaccaaatgatgaagattcttttcgggtacaaaacggcacatacccaatatgtagtttctttcagttatccccaattccctaaaatactcaggacagttcgtataatcgggacaaggcacaccattataaatcagatgaacctgctcggttctaccatatttccgtctgatcagattgcggatcacctcactgatgactattacctcatccgcaaacaggcatcccatccgctctccccatttcaaaaccattttggccataatcccccatttgtcacgatcatagtccggcccatggtgggtaaacaccactttcagtcccaacattttagcatacggtacaagcaatgccggtccgatggcatggatatgcaatacatccgcccccaactgttttgccttattcaccgccttgaacgtatgaacaatcgcttcaaacgatttctgtttaggagattctatatctatcagtttcacaccgttccattccgtcaacccgtcatgcacataattcttccggcggataaccgtcacatcctcccccctccttgcgatacgcggaaaaagctcctcacaatgcgtttccacaccacccatcacatcgggaatgccacgggtaccggtcacaataatcttcataaagaataaagcagtttaaaataaaaacagtagatttgcgacattaaatgtcaatcagccaatgaaaatattcaatttcataaaagaagtactgcaatatgccggaatcatcattctgtcatgcctttcggcactttggctgatgattacaggaaaaaagaaaaagtaagttagaatactagaacttttcccttaaatctccctggcagggatcttgccctacatcgcaccattttttatccagacagactgtttttccctgcatggaacgaagtttattctgcaacgcccacttcaacggatattttatatatttatgcatcaccggagaggctgtgcccaccatccagcaatttttcgggcatttacgcaccatggcacgtacttcctccgcctttttgcttgtccaaatagtcataaagtccggagtttcatgaatattccccatcgacttcttccaatatttctcttccagaccgttacagggaaacacatcaccaaacgggtctataaagaaattagcacttcccgcctcacaaggcagcatgcgccttcccccttcaatataatttatcagtcccatattgaaccaagcacgaaaccaactcttcgggtgattctccttcaactgccattctatcagttgctcaaagtcaccgcacacctcgttcttgttggtgatgacattgtcgtccttatgaaagtagtacgagttatgaaaggcggctgtagcaaattccattcccagtgacttgctgagctgatacaatgaaagcatatcctttgaattattattcgacacggtacagccgaaaccgatatccttcaagcccatctctttcaatgccaacaatgtacggagtcctttatcaaaccctccggcatgtccgcgtagttcgtcgtttttacaactcaaaccctcaatactgattcgaattccgatgatagggaactgtttcgccaaggcaatcaccctgtcctcaaaccatccgcttgtagaaatcacaatccggtctgtatgcttgtaacattcctccactatttccggcaaatcttcacgaatgaaaggctcacctcccgtcagattgatgaatttcaacttaggcaatgacttcaggtcacttgcttttatttcttcactcttgttagtggggttaaaccatatattacacatcttgcacttcatagggcaacgatatgtaaggattatgcttgcatcggtgggatgcaaggaacatttgttaaccataagttgtttgatttaattattcactattccaatttttctttcatattttcaatgaaagagttaaaagcaacctttatatcttccaattgaggattggaatttttaacgagaacagatgcatagtaatcagtagattctacttccactttagtggacaaaaaagtaaaactttcccgttgttcatattcataataccacatggaaaacaaacggttacgaatagcctgtttaccatccgacatatcacaaatatataatataacaggattgttttctaaaaagaatgtttcaagaattacccaaatagtttccctgaccaacggatcttttacagaatgcttaccttgtgattccaaaataaaaaactgaaacgcattctcatccataaaagtatagtcctcaacaaaccctacctcatagacagaaccatattgggtttcaaatcctaaactaccattattatttatataaactttatagggagataaagcattgacacgttctattggcaaatctatcacatcatgcaaattttgccattttaaatcccattttttccaattcttctaaggaatacccctttttgagatattctatcaacgtgcgtttgcggtctgtcgccttcttcatagcagccaacgcctcttccttggttttaaaattcttaatagccatccgatatttcttgatgatacaaaaatactagtaataaatgaattatccaatatttccctgtcttttctttccattatatactataaagcaacaaatcaaccctgatacaaattcataatctgttgataatacatttctgcaccatacagttcctgtccctttcctgctatcatttcataattgagaggatgttgcatcatactttcaatcttcattctcagatcctctttattacgactctcaaatgtcatgccggtaacaccctcttctatcagttcagggattcctccgatgcgtgctcccagtacaggtgtacccaaacattgcgcctctatcacagacaaaggattattctcataccactccgaaggtatcactgaaaaacgtgctcttcccactaactcctttatatcattccattgtttaaagccaacaaattccacgttattcccagctacggtctttaactcctccagcaagggcccccctccaatcaccaccaatttatatggtagagcatttgccgcctctatcaaggtccttactcctttttcaggactcaatctccctatgaaacagtaataatttccccttttggtataatccttaccataacatttctcagtatcaataaaattacatactgtttttatttttttactatcgaatcccccttgtcgcatcttctctgccataaaccgactagggcaaataaagatatccgtgcaaacttccaatcgttcacgattccacttcatagactcccaatacgataaataacttgccaagcgtgaatgcttcatacatttatattccaagactttacgcttatccgaaaaacattcttcgcatatagtatctccattacgcaaacagtcataacgcggacaaagcagcttgtaatcatgcaatgtccatattacttttattcctttttgatgcgcaatttctgcaataaccggagatagttgagaatgaatattattcagatgaacaatatcaggacaaaagtcatccaataatgccgtaaatttacgttttacttcattcgtaccaaaggggcgtaacaacgcctcaagcatacctaatcccggcttgaactttacttcaccaggaaagtacttgctccatggtgtttctatattatcaggatactgcatggcgaagattgccacttcatgacctttccgcttcaacaattcctcaaggtttatggtacagacacagtcgccgccacggcggtaatagaatttattcgagagtaagattttcattatcacagaagaatcaatattttatcattatgtataaatcattttaacattttcaatcttcatataacccccaataactatttattaatgtaccttcaccatatatattaagatagcttgttggatctacactcaaatttttaccaaatattaaagatttcatctttctttccaaatcatctatatcattaactttaaataacacaacatttaaagttgcattatcttcaaagaaaggaattgtagaggctaatacttttttattaaagtaatatgctaaagacaatacccctgacattgttgcagaacgataaggataaacaataaattttgcctttttaaaaagatatgcgacttcttcatcttctataaaacgatttattcgaataatgttttcattatgagtttcaatatcaaagcctctacctgcaatcactaattttagtgacttacatgttaaattgcaatacgcatcaaccagcaaatcaacccctttatatttatctactgttccaaaaaacaaaatatattcttttaagccacttacttctaatggcatttttttaccatttattatcaatgatgtaattagagaaggaaatgaagtgtatttcactttcttacatggatatatttctttcagttccttcaattggaaataagaggaagtcgtaagattaggaattatattcctacataatttatatccccatataatatatttttgcatcaaataacccaataaagtttttcttaccacctcatgtggatgcaaatcatgcactgtgtagtaaaatgttcttttattattcaaacaaatatacaaagctaatgtaaaatcacctgtcaaaaaatgaacagcatccggattaatacttttttccaattgcgataaatgttttattatctctagaggccatagtttataaaacaatttcatcattttactctttgggtattccaagaaaacagggttcgcttcttgtaaaattatattcctataagaataaatacctgaattaacacaaagacagtgtacttcaaatctatcatccttagctaaagcatttatagcagtagcagcaaaaggaatcattcccgaggcaaattcagaagcaacaaataatattttcttcttcattacaatctataatgttttcactcttgaataatataatattaagaacaagagaaataatagtaagatttcacaagagccaatagtagatgcaatcccccccataagtatgatgaataaagctataatacggctataatagaaccttttatcatccattaccattccatataaataatgaataaataatagccacaagatatagaagataaaatagtaatatccaaaatttatatataaatcattacataaagtcgtataaattcccccaccttcaaaatcatagtttgctaattcttttaatttataatcaaatgacaaaggcttatccggccacaaaaaacgaggtatgaattttacaagaccagtataatattcctctccccaaaagaagttctccgtaccaaccgcattcatgataggaatagaattagcttgataaagaattactggataagaaaagaatactgcaatttgggatgctataagagttaagtctccacctctaatgccttgtaatgtaccggctgctaatggcatagctaaataatataagacatattcataccacttaaaacctcttttcttcaaatgaaaaaacagtaaaaataatgtaaccccaacaagaacccctcctttatttcctgttgtcaaaaataagaaaacgctcaaacaaaaagaataaaaagcaacgactttataataacacttccatgtcttttggagaaaaagaacaagcattattatttgtatccctagcattggaatatccctaataaccccaactcctatttcactagttcttcttaaatcttctatattattcccccttaacaaattaattaatactccagacattactccagcccacaataaaaaaaacacaaaacaagaaagtagtatctttcgtttcttattcaatttaatagacgacaatggaagatttattgatattgggacttgtgcctgctttctaaatagaaatagaaacgaaaggtttataattgctgctgtaaatgtcgtatactgaatattctctggaacatctggataaaaaaatagaaatggaatagcatcattaaagataaagttcaaatagattaatatatatggagagaaaatatataatgttcttattctagaatattttaaaaatagataaacaacaattagaatatatagatataataaaagttccatcatctcattttttcaaatatttcctcccacctatctaccacagtttcgatattaaaacgtctgcaagtttctagcccctttattgctaatttatttctttgcatttcatctttcatcaaagactttaaagattctgcaaacatagtagtattaccataagaaatcaacacaccatttacatcattatcaataatatcatgcacagacaaaaatgaatccataacaatcggaactaccccattttgctgcgcctcaattatcgacattggaaatccttcaaatgcagatgtcatagcaaaaatagaagctcgcttataataaggtataggatatcgcctcccctcaaaatgaacattgggaatattattattgcgtgtaaaatctaagtaaaaggatttatccttaccatcacctacaatatataaatgccattcattaaattctttatctaattgaatatgcttccatatcgtcaataatttcgatatttttttatttgattctaacaatcttccaacaaataaaacctctttcctctttttacaaatttcatccatagaaataaaattatcaaagaccaaaggattataacaccagtccaatttttcaaccgattttggatttctcaattgtatatattggtctttaaactgaggcgaaagaaataatactttatcactaaagattaacaatttatctataacagataattgtctttctttttcaaagaaacggtatagcagaaaaaagacacgcttcaaaattgatttcaaacaaaaaccttctatcacactacgagtataaagagccgtatgatgaacagaaattattttcgcattaaaaaaacttcgtaatggagataaaaaaacaacaggccaccattgattgattataaaatcaaaactattctgctgatacaattttaaagcgatagtaatcttaataccatcatcactatcataagtatattcatcacacctcacatccggtattcttaccgccttgatagaaggatcaatatagggcaattcatttgtttcagaatccttaaaataaaagactgtaacagcatgccctctcttcgccatctcattagctaaacaaatagttactgtttcacctcctccataaataggccaaagtcgcaataaaaatacaatattcatatttacaaataatcagtttaacaatgtattcaaaaaagaattcactgtatttagtttcaaatactcttgaccatctatggtcataagcttgtttagcaggcaagactctaaaaaagttttaatacccaatatttccacatcactacttatatatcctaatttcgatttccgaactattttacccaacatatttgagctaggagaaaaaactggaacattaaactgtgctgcatatcctaatactccactactttgtgaattattcaaataaggaattaaaaggacattcgatgatttacatatagcagatatttcctcataagaacaaaaataatcctttattatcagccgatatttctcactacattctgctgccagtctataaaactcatcctttatatccaaatctatttttcctgcaaaaacaaagacaaattgatttctatcaacaacagacatttcttttatcgctttcaatatgttaagtgttccttttctttcagataagactccaatatgagaaagcacaatagcatcttcttttacagcattatcttttctaaaatccggcaaagttagtgtaatggaaacataaggatcagatatacgatcaaacttcattgtctgatatttacgattaaaaaatgcagcagaagatgaatcattacaaatacatattttcttgattgacttgttatgagccatcttccaaaatataattgactttaagattctttgctttatagataagtcagcccattcatataaataaatataataatatatgccaatataggaaacttttttcatcgtcataaaagcaaaaagagggtctaaacaatcataagagcacattattacatctgttatatcgtacttccgtatcttttcatttaataatctattcccccaatatgactttaatatttttttagtatgatgcaatctttctaattccctaactgtcagatatcgcagtataatatttttcttaagcactaattgctcacattcaatatgttttttaaaatccggcgagaaaataaaataataggtattcttttcatcatctatcgcataatgatatatatgaataaaatactctaggacatgccctccaaaagaagtatacataaataagaaacgtttcatcacctataatttagaaatcatacaatggtacaatgccttaaaatcagaccaatatctgcatttaggttctattaacctatctcccaaacttccagatatccctctccaatataagaaaaagggtatcttatgaattcttatttttcctttattctgacgtaaagaatcaaataataagtgttcaaagtaatatcctactgaatcatctatatgaaatttatcttttagaaagatattctccaaatagtatttgttacagacaaaacatcgtgaatctaccgaattgttttggggtgggacaacacaaacaaaattcttacttggacttagtttatccatataatgtatcaatcgatttatattaatcaattgtaacctccctgtcaacttaaaaatcaacacatcatcagtaataaattcagatttggccattgcatattccaatataagcgcctctccataccctttcccttttctcttatcaaaacatagattgccatcaaaacacaaaaattcaattctatgctggaaatctttaaacgaagatgagatatcagttcctgaattttcaacaaatacaatttttctcgttgtgttttttaggtaaaaattcaaagcctcgatgtattgtttctttctcactcctacatctgccaaacaagtaaatggcataccatcaggattaatacaagctgttagtaatagtatatattccatataaaagactatttgtttttatttaatccaaattccagaagcagttcctctaataattttggttaattgttttttagctacaaatgcttgaatcaaacaaacactgataggcactaataacatcacagttattccatatttagaacacaaaaagtacattgtcggaacagaaataaaagcagataccaaatagacgaccaactgcaatcggattttgcttgttccatttatcatatatatatatattccacataaattctgtactaaaatataaacacctaccattactgatagagataatgatattttaacactatctccgacccatatatcataaaaagtactggatacaagaatcattattattaatacacagatacttagtttccaaatcatctccattttctctattacgtttttcatccacaaaaaatcttttttagtatacgcgtcagcacatgcagaccaaaaaggagttactataatcatcatagccatattaagaatattaaaatatttatatgcaatattatatgccgtcacgttttcaggtccacaaacacgaacaataattatatttatcacttgaaatataaataacatacataccataataataaaaaactgtgcacccaatcctatgattttttttgttaaagcccaatttattgtattcatacttggagctacatcacagtatctttttgaagaaaaaacgaaaaaagaagctacaaataagactaataatggaatgacagataaagcaaaagctaaatataataaacgaccagcagttaccctaattaagataccaattacaattaaagacataatttgtccaataactataaataaagatgaataaaccggtctttggtctgcggttagcatcgttggtaacacacttgcaatcatattcaaacagagtgttatagtcagtacagcaaaaactaaacgcaattcatgaccatattctaaaccaacattaagtaatgaactccaatccaaaaaactattaataacaagaacgacaaatgccatagtaacgaatattatagtcaagacagcataagtcgtgctgacatattgtttagctaattccctatcatttaaagccattgcttccgtaaaacggtttctaaatccatgagcaaagccaaaatcaaaataactaatccaggcaacaatcgaactaatagttagccataaaccatactgagcagaagatacataattaactgtcataggcactaatatcaaagagataataatacctataatttttattccaaaagaagctataatatttctcttggcaagaacatttctctcattgcctttttttaaataaatatctattctatttttgatagctaataaattcatttcagattttgctacactcctataaaagaaatttaacatttttgattaattatttatatgatatttttttataaaaacaccatccttaccgccatatcatgccacctatagtaatcccttgccgccaacaaattatcagacaaaattttatgataaacaccatcacacaaaacaacatgtttgcgaaaacacccctcaacctcatcaacaggcacagaagccatcaccacatactccggacaacctggaacacaaaacaaagaaagttcacttttcggaaacagaccgcacaatctacaggcggaacgctcaaatgccacccaatacgtacctatatgatataggtgcataaaccggtcattattcttttccctattcagtatatcagtgtggctgttttggataagccgttgaaggagtacaccagaaggaaccacttcattcatagttatataaagtaaatattatcagatgactcactttgtacagcatgacaaaggatttaaataggaaaagtaattcaagcaagacaaataccatcatttctttttaggttctttaatcacttcaatcaaatccggcgaaatagttgccatagccatggcaatgattccctgaatgcaaatgaccaccctgcggtctcttgcccctttcacctttataaagataccttcataccccgcaaagtctcccccgatgatgcgcacccgtgttcctttagccggattgatttcctccggtttgaaaaaaagcagatgctcgtcatacgtgcctgcaacggctatgaagtccctcatttgcccatcgggcacaatgattttctcaccgctacgcgagtcagtcatatactgaagataaggaatatcttttttcaattccttcatatcagtctgtgtgatatggataaagataagattatgaactactgggaccagctcgcgcaccttacgtttctttgccatgcggataacataatgcatgggaatgaaactggataccccttgttggtccagcagattcttcacatccagttcgcgacggtaagtgacccgcatggcaaaccattgtgttttttcacaacaaaacatactcttggggctttgacgtacgtatatctttctgtacttcaatcagttacattaccctttcggataatacaagaagttttgacttcttttttatgaaggtcggccggaagctatttcatgataggagatatggaatctacattattaattgatgcagcatatcgggccaactttgaccttccgcagattcccgaaccggatggttcttatgtgttaaatcagaaattgtgatacgtatataaagaaaaagcgcgggaatctgtacctgttactcatcctgcactttgaggccttcgcattgcccaccctgtccgaacgagcaacgcagaagcccacgccgatatgtacaacttgaatacctctttgaccagcaaagatgaaacaagaacattaacatatcgcgcagacacctactgttgctttgtttgtggcagggttagaaatttgcgaagtttcaaagtgccaagaacaaaacgccaagtaaacgtcttttctatatatatgtattttccactctcccataccccccttacggaagtatcagcatggaaaacacggcaaagatacggaattataaatagaatagaaaataattcccattttttgtacccatgaatttcttttttgtaatccgccacatcatttttacaataaatttgtgcacattgtgtcttatctcgtaccagaaagcacgcttttttacgtacatcccgcagggagccacacatacgtacaggactatgaatgcgtacgtatgtgaaatcatggccgaaagatccagaattccacctcaaaagacaaggacgttttttcaaaagatcaagagcttttcagaaaagataacggccttttagggaaagaacaggagctttttttagtagggagtaacaaagaagtttttcggcaaaagtctgtcacatctgtcacagcaagcttaaacttattaataaacaggaacttacaggtgtgacggatagtgtgacagatagatgacggactttttatctgtcacaacatacagataaaaaggtactctgccaatcatccttagaagcaaggttaaagagtagtcaacagacagtgtcaaactacattccgaagtctcaggcttacagtggaatagaaagttccaccggttggaacagcttgtttcatcaatatggaataatttattccacagtgaggaactatttattccaaccggacaaaaccatttgttccgcccttatggaacaagttattccactgcggaaagccatttgttcctaatggtggaacacactattccacagtgaattatgcagcaaagtccaatgactgtatagctttgaaaaccggacatactactgatgattccatacacattgacatgattcagacatcgtgtgacagataaaagtccgtcacacatctgtcacactatccgtcacactagtaagcatctgtttatcaacaagttgaaaacaactgtgacggatgtgacggacttttatgaaaaaaactttttttgtcgctcccaactttgttgtggatcttggctgataacgatgactaaaataaaattacctcacctctttccactcggaaatggttcgcgtctgtgaagaaaataccactcctatacaaactatttttcgcttatccgccagataaggttgggcatatcctttttcttctatctgacgcaaggcttcatcggcgctgccgtccagtttgaattcaaaaatataaatatattgcggagtctcgagtatgcagtccacccgtccccggctttgtgtctgttcaatgcggaggcaatatacccctataagacggagaatgagatagaatgtgtactggaaatgcttctcggtcagttccggagtcttggtactgtcatgcgaatcgtatgggataccggacaagaaagctgtgagggaatcgcggaaagcagctgtcttgcccgcattcagcagacggacagaactgatcagccaactggaaacggaaactccctgtactttgaaataatcactggccaacaagctaaggaaacctctgcgtacttcatcattggggaaatccagcagataggaatgggtatatttatcgtaatccttgatagtaagatatccactctggtaaatcatgggaagagggcgttccacatcagctttgtaatcggcaaacaaggatgcgtcataatattgccccaccaattcattgatctgctcgttgctatgctgcaacagccggaccagataggtaggcgtgcccgaggcgaaccagtagtcacggatttgtaaagaatcaaaagcgttcagaatactgaaagggttataaatatcaagcatattttcactgaagtgataaccgtcatattgtgctttcagacgttctttcatttcctcatacgtgcattcgtctttttcggccaactcggaaataggttcatggaaataacgctccatttcctcctgggtgattccgcacagtgattcataacgcgggtccatactgatatctttaggctggttgaaaccgctgaagacactgacttgcgaaaatttggtgactcccgtcagcatcacgaactgcaaatatttatcagctcccttgaaggtagaataaaaagctttcagcgtattccggttctcttcttccaagggggtatcaagcacatcgagaatgggtttgtcatattcgtcaacgagcaccacggcacgccgtcctgtcttttcgctggcgcgacgcagtaattcgataaaacgggttcccggtgttgtgtaattgggattcttgccatacatatcttcccaatttcccaaatagccttcaatagcagcttccagcactccttctttggcaaagttatcaccgttgaaatctatatgaaataccggatattgaaaccagtctttttccagtccggcaatggcaagtccttcaaacaactcttttcgcccttcataataggcttcaagggtactgatcatcaaacttttgccgaaacggcgcggacggctgagaaaatagatacttcctctgctcactaactgatggatgagggcagtcttgtctatataaacatatccgttttcgcggatgcggctgaaagtttgtatgccgatagggtatttcatattttgatgtatttagtgcatgatattgcaaagataaccaaaaccaaccgatttcacccaatcttggttgaatattttcatttttccccgctaattgagaataaatttctcattccagctatttatgttcctgtaaaaaaacagcagaatgcaatatactcgaaaggtaaccggtgaaatacatacagattcatcgtcatccggttgaatttgctaataccggttagaaacaggaacgtcatacttttcagaaacggatacggaaacgggtcagtttatccggataggtacgaagagagaaagtacacccatgttttatcaaaacttcacgaataaaaataagaccgataccctgtccgttaggcttggtggagaagaaaggactgaacagcttggtttccacctctttactgataccggcaccggtatcagcaatttccaacatcgtaggtgatacggaagtacggataaagatatctcctgtttccccgatactttcagccgcattcttgataatgttgaccaatacttgctcaaacaaggaagtatccatcatcacttcgggattctctttacataaattaagatgcagcgtaatcttgcggttacggcaaaccgtttccataaatgtcttgcaagcggccacgcggtcattcaagtccactgattgtaattgaggctcgggaatcttcaccacattggcgaaattcgtgataaaacggctcatgctgtagcaacgctctatgcagactttcatcacttcgcgcaagtcttccgtatcctccatacattccaaggcaccatccaccgtatcaagagtagaggtaatgcccgcagtcgtattattcacctcatgtgctatcatacggatcactttttcgtatgcctttttctctgctttcaccacctcggaagtcagactttccaccagaataaacggatgagaaaagcctctgtcaacaaaagaaagccgggaacagcggtaaatcatggagtcgctcagacgaattgtttccgtagtatctttgggaatacgttctatttcttcggccaaaggggaagccaactcgcacagcaatcggcctctgacttcctctgacgaagaataatccaaaaaacgaagagctgccgcattcagcatggaaatatgtccgtccagagtcagtatgacaactcccataggagaagcactgaccagcaagtcaagaaaatgattctgctcacgcaaccggagacgctcgtctttcaactgctccatcatgcggttgaaaaccaacacaatgcggtcggcttccttttgtccgacaggagtcagcctactgctgaaatcctgctcacgaagaagttccataccgttgccgatgatatcaagcggtttcacgactttgcgatagaaataaaccagaaacacaagactgaatgtaatgactccctctcctatataaaacagcgcaccgcgttccttcaatgtaagaacgagcaggatagtccatactgctgtcaacagtaatgctaaaaagaagaacaagaatttcagtttcatattttatccggttccgtttttgctaatcattcacttgtatattgtatttctccaaacggcgataaagagcggcccggctgattcctaaggctatggcaacctgtgacatattattgttatacttttcaagcgtttgcagaatagtctgcttttctatctcctccaaggtcatgccttgcagattcgttgtcatcttctgttctataggatgctggtattgtgatttaaaatcatccgcagtcaatatttcctttccactgaccagcaaggtacgttccaccaaattctttaattcacggatattacccggataaggcaaacggctcaaataatccatcgcttcagaagtaaattccactttgggaagaccgttcgattcacattgtttgtcggcgaaatgacggaccaataacggaatatcctcacggcgttcgcgtaatgccggaagatgcaccgtaattaaattaatacgatagaacaaatcctcgcggaaggtgtgttcctgcaccatctgccgtaaatcggcattcgtcgcactgaccacacggatatcgactttacggggacggctgtcgcccaaaacttcaaaagtctgctcttgtaacacgcgaagcagtttcacctgacagcttaaatccaaatcgccaatctcatccaagaaaatcgtacccttatcagccagttcaaaacgtcctaccctgtcggctgtggcatccgtaaacgcacctttcttatgaccgaacatttcactctcgaacaaagtatgagaaatacctcccaaattcactttcacaaaaggtttcttgctacgggaactgttcaaatgcaccgcttcggctatcaactccttacctgtaccactttcaccggtaatcaagaccgatgcgttggtacgcgctatccgcttgatcgtggccagcacatccatcagtgccttactctttccaatgatatggctacggttgaagccgtcattatcttccaccggaaccgctgctttcttatcttgtgaagtcagctccaaagcagtttctatcctttgcatcaacgctacgttgttccaaggtttggtaataaagtcgaatgcacctgcctgcatcccttgcacggcaagctggatacttccccatgccgtcatcaatataacgggaacatcgggccggaacactttgacctgtttcaaaagcgtcaatccttcttcaccactggtggacagggtgaagttcatatccatcaagattaactggggtgcaaccgaacggactatttcaatagcctctttgggacccggtacggcctgcacatcatatttcgccctttttagcataaagctcagagaagaacgaatggcactgtcatcgtctataattaatatcatactgctgcaaatgtagaaattattattttaataagtacaaagacaaccccattttatattcaaacagaattgaatagtaaaaatcctattgtttgataatcttttcgaaatcggcatcaatattagtattggtattgaaatcccacaatgtcaagctgcgcaactggtaataatagtaccaataatagaacaactcattgatatgcttctgacgagcctcatctttctttgtctgggagtcattcaaatccaatgtcgagattttaccaaccatgaaggtttccacattggtactgtaacgtttctgggcaatcttgtccgcatcgtctgctatctgcaactgggcctgctgattattgaactgttctacaaggataaacagattctgattgaaattcatggtttcctgacgtaacttgctttcggtcacatcgcggttactttgagctatctttacctgaccacgacgttttccccagtcaagaataggaatcttaaaaccgacttccacaatctggttgtctttcaaacggcggtatgcactattaaattcattgtctgttcctgtaaaacctacctgtgcatagagcttgatttcacgtaaattacctttcgccttagccacttcaaaatctgcttccaactggcggcgacgaatattatgtgcaaatgaattattggcaagtgctttgtccaaaacatccggatagttcagcaaaacagtcggaatcgtttcgggaacaaccggctccagttcctcatcctctcctaatgccagaaatgaacggagtttgaacatattacttttcaagttgctttcattttcagtcaacgtagaacgggcattcaatacattcagttccaattgcaacaaatcattttcactgatctgccccatgctacgctttgccttagccacttcatacagtttatctgcattcttcagattctgtcgggcaatgcctacattttccttggccagcaacaaattgaaaaaataattgatagtagtcatggttacctcttcggttgcagtaagaaatgcggctttagcttcagcgtatctcaccggttcgatgcggcggttccatttaattgtattcactccgaaaataggttgttccaaagtcaatgccacaggaacagacatatatcgttttgatttatctccatccagttgtttcaagaaatcaagagaggtattcaatgagagtttaccaccggtcaaccaaatattctgatcgatagaaacttcaccattcatttccatataattattacgtacaaatgtataagcaccgttatcctgctgataagaattatacttcttattatagctgggaatagtggcttcaaaattcatttccggaagcaaatccgcacggaaagtacgatattcccaataagcggttttcagctcgtttaaagctacggccgcatctacactttgcacacgggcaatagtaatggcttcctccaaagtgatggcacgtcgcttttcttgtggctgcgctccggcaaccaacgatatgccaaaggctaaaaatagagatattacttgttttttcattgcgttattattctttttatcaaaggtaaggcaaatggtatgccaaaaaactatttcactgttttataacaccttacaacaaaaatggagtgtccgaaatcggacactccattcatatacgaacactgctgatcatgtgacaatgaaataacattattcattatgcaacgcgtctgcaggctcaatcctcatcgctttccgggcggggaaataaatgccgagcaaaattattatccccaacaacagcatggccgacacaaaacaaagcaaaaaacgtccccaagcaggttccattaatgtatgcacagtaagatccgccatctgcatattcgcacaaacaaaaacagcgggaatggcagccgaaaccaagagaaggatgccctcaagtacataataaccaaatacattcatcctactgcaacctagtgccatacgcaaagctatctcacttcggtttttacgagtccgaaaccagaaagtacccagcatccctaaaaatatattgaaaacaaagaaaaggataacggcataggtagtattcagataattcaccgttccttgctctatatcgaaagcttccttcatatcgccatacgaatttatatcgtataagtaataagggccgatagataatttcccttgcatatcctgcataaaacgttcggtaaatcccggtatggaattagaagccacacgcaccgcaatgtgatgccaataagtcagcggcgaactgggaagataaataaaaggttcgtaacgctcgtactcatcggtcttatgagcaggaagtaccgccattaccttataattagtttccggctgcacactattcaggaaataaggattgaaacaagtttcccctactccattgcgtccgctaaacaaggaatcgcttaacgtttcactcatcaacaccggcatggggtattcattcttgtcccaacgctccgcctcaaatgaacctgataatggctgcaagcgaaataccttgaaataagtagggctgacataacggatgaaacagcctaccacatgagtcgaatccgaatgcggagcatatccctcatacatattatttcccgtataaggtattgtcccataataaaaacaagcttcctccaccccttgatattgttggatcaaatgatagatttgctccaaatattcagcagaatgactcattaatacagaatcattttgcaaagccggcttaatattcagttgaatatcaaaaacattctccgtgtcatatcctttagactgacgggcagcaacctcataattataaaccagatcgatgctgtaccatagcaagacaagaacaacaaccaattcaacccacacccatacattagcgtgcctttggttccacatttgtctgaataaactctttatcatttttcctttcctcctattctcctttaatggtagttgcaatattacgatgtgtgaccatccataccggaatcaataccgacaataaattaaaaacaacacatacgccgaaaaccaacacaaataaagcaggatgcaacaacaaacctccatccagactgatacctgataattctacctcgccgctaccaaacaaccatacacgtcccagccaaaccaaaacacacgaaaacagatatcctaaaattccacccaaaaagaccgtaagcagattctctaaaaacaacctcaccataatggaaatacgtgatgcgccatacgccttgcgaactgcaatttctgtcacacgctcctgcattcgggcattggtcatacctgagatattaatagcaggaacaatcagcaagaccatcaataacatactgtaaaccaacggtgcactaatatcttttccacgaaaaaaggtgtattccgtatgagtatagagttcgttcatctcgaaagcatattctgccgttgaactattcaaacgatcctgccgatgctgtacttcagtccgtacctctgcaggacgagtatccggcagcagtttgagcaatcccagacggattcctcccaagccccctgtccaagtagcataatagtcttcattttccaatgagaaaggaacaaaagcatcagcgtatgctgtctggaaaatagcattgacatctttcaccacgcctaccactttagtaggaaaaaaattactttgatattcttttcctaccacatccgtcgtgccgaaaagctgcaaggccatacgctcggttatcacactgacccaccgacgggcatcatactcctcttgtgtgaaaggacgtcccgctataaattcataatcaaagaacttaaaccagttatcagccacaggccgcacataatagttgaatatctcattcgaagcggacaagttacaaggggtcttggaaacgccacgataccaagtaacctcttttacactaggaagctctgaaaacaatgcttcaaaagccttgcgtcccataccgctgttctggttggtatgatccagcttacgataggtcattcccgaacctgtatacatcatatcgctccgatcactttccggagccatatccattgtacggaagtcataaatcatcactactaccataacaaaagcgatagtgacagctgttcctataatactgattgtagcataaaaaggattctgccgtatcagattaaatgcttgtaataatagctgtttcattcgttttatctcttcattttatttattcttcatgtaatgcctcagccggttcgatactcatggcacgacgggcagggtatcctattccaatgacaatcattccagcaatcagaataaaagtgcccagaaccgtaatcgcaaaacgacctgccgtaaaaggcatacgtgtaacttccaccagttcggcatatcccaaattccacgccacaaccaatgcaggaatagcagatatcagcaataacaagactccttcccccatcagacgaccgcagattccccaacgggtagatcctaaagccatacgcaacgctatttcggcacgccgatgctgtgtccggaaccagaaagttccgataatgcctagaaagatattcagcaataagaaaaatatgatacaaaattgcgtattcaactcattcaccgaatccgtttcataagctgtgcgtacatcactcaaaggagttatatccaaaagatatagattgcccacctgatattgacggtcggcatccactatcaaacggtctatgactccatcattctgtccctcacgaacacgcaggcaaacttctatataaaccgtctcacctaaggattccaacgcctcatctgtcaggtacacagcagcataacgggagccgtaatcatccggagctgtaaaatggtcataacggaccggctcggtaagagcagctatagaaagatgctccgcctccggctcattccgccaaacaggcaccctacgccctaaaagttccttaccatgccaaggtgcatcctgataaacatcggcaatattcacagataagaccatgccggacggtgtcagtgcctcagcaaggctttcactacccgaaccgtctatattgcggtaacggaatacattaaaatactccggagttatccatcgtttcaaactacgtaccgggactgtatccagataaaatgaaaaactgtttgcaccgtcattataaggtatacagttttgcgagaggctgactgcttccacatccggacgatgcgcaagcctgtttacaatttcatgcaaatcggcaacatcttctttcatagtacggccaggctgataagcagccgccttcgaagtcatccgctcaaaacgaagaacatacgtattttctatatcaaagcccatcggcaaattatagatgctcaacgtgacatataccacatccacaatataccataatatgacaaacaccacaaaaagttccatccacagaaacgcattgctgcggcgctcgttccatatctgtttcaataaattcctgttcatgatctaacgttggtttaaagcgtccgtaatattcatgcgcgatgccctccaggcagggatgcacgctgacagcaaattcaagagcaggcagaaaatgaatgcggccaagaatatccagggactgaacaacatatctgccgaaagactggtttctcctatttgggcacggttctcgctattggaaaataagaaatcattcaataaaaaagtacatgcataactgaaaagcattcctactgctccggctatgagcgtcaataataaattttcataaaacacttgcctcaacaagacattggcagtagcaccaaatgccttcctcacccctatttccgacatacgcttccgcatacgggacaaagtcatgctactcaaatttatagccggtaccagcaataaaataacaatcaccaacaggtagtgcaaataagcttccttcgcctgtaactctcttccccagtgacgaaagataaaagagaaacgatcatcgggttgtccacgataaaaaatttcggaatcctgcaatccgtcattgaatttctgacgcaggcgttccgcctcttctctgatggcaggaaaatctttctccgaatgtgccagaatgaccacacgaaaagttcccatcgcattgtcataccagcacttcctggctatttctgttgaattgaaaggtatccaaatctgtgcataagaagaaacagccagtttggatacatctttcacaacacccactaccgtataatcggccaagttgagttggaccgtacgtcctaccgcttctaccgtaccaaacaaattccgggccacagaagcactaagtacaaccttaggaagtccgctttcactatcggcagccgtaaacggctttccggcaataaaatcaaaagagaacactttccaaaaggtatcgtcagtttcaaggttatccactgtcatcatttttccagcaggtacagaaatacgcatcctgcctcctgtagacactatagttaccgcctcaggaacagtaagtgccttaaaacactctttagccactgtgagtgacatacagccgtttgatgaattatcactggtatctcctttctgatgaatagacatcgctttcatataaagagaacgtgaacggttcacctcgggcacacaatccgtaatgcgtacttccaacaccaggacaatgaccatgatcatacaaatagccaatgccgttcctatgatagaaaccaagctgatgagcctattctcacgaagttggtaaaaagcctgtttaatatatagttttatcatgtttgtgctatgctctaaaaccttttaacaaaaaagagattactcattatgcaatgcttccgccggctgaactttcatagccttacgtgcgggaatccaaatgcctactacaatcatcaatgcaatcaaaataaaggaaataagaactgttattatgaaacgtccaccttcaatagtagtgccattcatccaagcattcaattcactatttgccagattccaatcaataaaaatcgcaggaattgtggccaccgccaataatatcaatccctctgccaactgacggacaaagatactatgatctgttccacccaatgatttcatcaatgcaatctcaccacgtcgttgctgagtacggaaccagaaagtacctagcaatcccaagaatatattcaacaacaagaaacccattccgaaaaggtaactgttccaggcattcgtatgtgactgctgaaagttacgacggatatcggtaaaagaacgcacatccgcgataaacacattgcccacgcgatacagtttctcactatccgctttcaaacgggctataaaatcgcgatcttgatcctcttttacgcgtacacaaagctccgtgcccaaatcataccattcttccggcataggagccaccatgcagtaactgttccatgcctcaaaataatccccataacgcacaacctgcaaagaagctgctaaattatatgtattcgttgtatccccgaacaaataaaattgtttgtctaccaatgaagtcaaatcacatccatagcgccgtttataaagattatctgaagctaagaaattcttcggatgtttcagcatctcagccagttgttcaggggtctccccacgggtgccacgataacggaacacacggacaaaatcgggagacaccaatctgcgtatagtccatcccggcgaacgtaatgtatcatacaccactgacgcactgctgttactgccattatacgggtaagaattttgtcctaatccggctgcctctatatccggtctatgctgaagacgacttagaagttccttgatatcctgccgcttttcctcgtctgtctgattgggaataaagtctggacttttgtccgtaagacgtcccatttgcaccaaatagcaatgagaaatatcaaatccccgtggttcattataaattgaggtctgcacatacatatagtccacaatataccataaaacgacacttaccaacaataattcggtgacaagccaaagattagaccgccattcattttttatctgagtaaatagtttcttattcatcttgattctttacttttaattcgttatcaccttagtgaatccttcctcccagtgcattgacaatgctagtccttgaagccctccaagcaggaatgccgctactcagcaaattcaaaacaaagcaaaacaacaacgcataaaggaaagtggaagggtgcaataaaatactggaatcaactgtaggggcattcaatgtcgcactataaggctgtgcaaacaggatatcggtacctaaataagccataacaatactgataaacaaacctacggcaccagccaacaaagtcacgaccaggttttccatgattatttgtccaaccatttccatgcgggtgctcccaaaagcacggcgtactcctatttccgccacacgttggcgcaaccggctttgcgtcatactgctcagatttatagcaggtactaacaacagaatgataaaaatgatagcacgttcacgacgagccgacttcaaatccggctccaagttagctgcaaatgaaatagactgagtttcctgatcgtatggccggttacggtctatcaacgtatacccctgatcggcaagaatagaattatactcactcatacgccgcttggcttcagcacggatttctccaaaatcatcatggcttcgagccaaaatagtgacactcatcatccccatgtgctggtcactccacgtatcactaggcaaatccgtcgaagtaaagggaatccatacttggccataagaagcatcggcaagagtagatacatctttcactacccctaccacacgatagggagcatgattcaacaaaaactctttgcccgcagattctgtggaaccaaacaaagcccgcgatatgctctcagtaatcacagccacaggagtgcccgcattgaaagtagcttcatcgtatggttttccattcacaaaacgaaaatcgaacactttaaaaaaagtatcatccgtttcccgcacatccgctccaatagccggcatagcgggtaatgaaacaggagtcgataccggcatactgcaataaatagtgacagcttcaggggttttcaatgatttatatacctcacgcgccgtccgcacgctcatcggtccgttacttgttccgtccccccaatccttatgacttatgctcatataatgcacatgcagaaaacgattccggtttgactcgggagaaaaaggagcgaccttcacttgttgtagcatcactaccaacataataaggaaaatgctaagagcagttcctgcaatgctgatgacactgataagcggatgctggcgaagttgcgccaaagcttgcttaaaatactgtttaatcatctctgttatttcttaataaattccttttcatagtaatcagtagttattgcacctgacgcccatcaaagaaacgaatggttctggaagtctgtttggcttgttcttcattatgggttaccatcacaatggtccgtccatcctctttatttaatttatgcaacaattccatgacctctgcacccatctttgagtccagattaccggtaggctcatccgcaagaataatttcaggattacccacaatagcacgggctatcgctacacgctggcactgtcctccggaaagctgtgtgggcatgtgccgcatacgatgacttaaaccgacacgatccaacacttcttttgccagacgggtacgctccttggcagccatctttctatagagcaaaggcaactccacattgtcaatcacattcagcgaattaatcaggtggaacgactggaatacaaagcccaaggtcttgttacggaaagcagccagttccttgtccttcatgctttctacagacgtgccgtttatttcaatctttccactgctgggagcgtccagcagccccataatattcagcaaggtagacttgccgcaaccggaaggacccataatgctgacaaactcccctttagccacatccaaatttacattttccagcgctaatgtttcaatctcattcgtacggtagattttattgataccggttaatttaatcattgccatatttttttcttatttaaattgttaatcttatacactttctattttcatgaatcaaaagacattccaaagctataatcatttaatattcaacgaattttaattctacatactgtccgataacagacggtgtgaccgtttttaccggactaatacgactgatgctgtatgccggaaaaaaatgtcaacaagcactatgaataatataaaaaggtaaacgatcaaaaaaacgacatagcctaagaacaaattaaattatgttcgggaaatgagtgaaaaggatgaaaaaacacttcatttcccgtaacaatcaatgtattaattaagagagagttttatcttgttgtttatgtcatagctgcttcttatttcaacttcagcttattcttgtttttgtaactgctcatatcgctgacaaccaccttgtcacccggtttcaaccccgatatgacttccacatattcaaaattactatcacccaattgaaccttacgctttactatttcatccttactatcctgaacaaataattcatactcaccgcgaccgacatagtaagaagcattcgccaatcttaaaaccccttctttcacggcattcattacatacacatctgtcttcaagccggaacgcaatcgcttgttattatcttcattcagttgtacaataaacgaaatcaccccattcttactcaacggtgtcacactacttaccgttccttccagtttctcattgccaatcttgactatggcacgtccacctgctgccacacggtcaccgtatgtatcagctatttcaccttccactttaaaatggctcaaatcagaaatgatagctacctggctgccttccgctacctgcgcacctacctgattatttatataggtaagaatcgctttacgcggtgaacgaatttgagcgtcatccaatgtacgtttcatttcagcaagactctttgagaaaatattgaattccaattccttcactttcaaatcagcctcttttactttcgattcattcgcgtattgctgacggagctgttccaattccaattttccggtattaaagttcagttcagcctgacgaaccttgtccgttgttccagagcccaaactatccaaataacgttcgttacgaagttccacctccatacggttcaatttcatggcggaaattttcacttgcatcgataaatcactcagatacgtattattattcactttcaactgctctaactgataacgtttcatctgttcttcatccagtaatttcttgtattcggtttccgtactctgcaaatcaagtttcaaaatcggcgtacctacatccacactgtctcctcccttacggtaaacttccacgatacgagtattaataggtgaattgataatctcttcaaaagccggaacaaccttaccggaagcactgacacttacttcaatagttccattgtccacttctgaaaacaccaaatctttcctattgacgctgcttcgcataaacgaaatcaatacagctatacataccactgccgccacacctattgcaccatatttaatgaacttctttttgcgctccttatcacgcacttctttaggaatttctctgtccataacttattgtaattttattattatcatttttgtgctaaagaataaacaacatccgtgccaaggaaacaacttattgataatcaacaacaaataaagcgtacagggtgtccgatatcggacaccctgtacgcttttaaacatcagttaccgtacaataatgattaacgcaaacgcaatatatcacctactttaggagaagggtcttccggtttcatcttattcatcttatataaatttttcagacgaataccatatttttgggaaatggaatacatagattctcccccacggacaacatgaactatgtgttccttatccgcacgacgatgctttttatccaaataaataatatctcctggcttcaatacatatcccttataaagatcattgtatttcctcaacttgcgttgactgatatcaaattctttagaaagttttttaaatgtatcccccggacgtaccacaatatagagtaaatcattagccaaataaggctgatgcgggtttgggaattccttcatccactttataccatccttggtatcatacttatgtaattcatataattcaatgatatcaattaaacgatatgcatagcgagggtcagtagcatatcccgctttcttcagcccatgcgcccatcctttataatcggtgatttttaatttaaaaagagatgcataacgtgaacgtccttttaaaaatttagaatgatcttcatatgaatcacgagggtgcttataggcacgaaaacattcattacggacatcatcatcatgccgtacagtacgaccagtccagtcaccaccacattttataccgaaatgattattggatttacgagccagtgtactttttcccgctcctgattccaataatccttgagccaaagtgatgctggcaggaatacgataccgtttcatctcatcgatagcgagatctttatacttatgaatatattcctcatactgccggttacgggtttgcgcttgcactgtaaaattacatagacaacaaaacaacccgattaatataaatttcaacgtatgtttcatcatataaaactgtttcaaaatcgcgactatactttttccgctatatatagttgcaaacttaccatttttatccggctgtatgcaatctttttaaattaattacgaatttcattcgaattccaaaagtccaaagaaatccggacgatgaaaatccggcttctctattttaataggattccatgataagaaatgaggcttttgcaattcatctccacatttataaaaattagcccgtatgctcattccatccagcccggtaatggcatgcttaaaaaataccttatacggaatcagcaaagccacctcccaagtacattctcctatcttttcttcaaaagtttctctgcccaagctagcccaacgcttcacctgatccgttatttcagaaggagccatttcacgattattacgctccgaacctgctgctaaaagaatcgtagcgatacagttacattccaaattataataaatgccatctcccgcaggaatagagaaaaattccacacaggaatctgtccaaacactaccgttatcttcaccgtatttggcacgaacactgtcttctactactttataatggactaatatagcatcatttgtataggctatacgaaaagagacttgaggttgataaggatattctttccagttcactatatcaataggatgatacgtaatgttctcattatcaaacaaggtcggtatttgttgtgcatcttgaactttaccacttaatttctttactttcatcgtattgtttttattagttaaatagctactattagcttcacaaaaatatatacttccactgagaaaacaaaatagtggctaccataaacagcagccactaaaagaataaagctataaagacaatgaaagcacaatttttacattttcatccatatttatttcttcacatcgccctgtggcatatgtcttctcccatcatgctgttttttcattccttgtctttttctcatctctttacggaatttatcgccattgtgtttctccatattatacattttctgaatttgtttaggagaaagaaatttccggaactcattataatacttctcacgaacatccagtatctttctactctgcgcgaaacgtgccttgatagcctgctccacttcagcatctgtaggaagcggtttgggggtctgtttatctgcagccgttctatttgcaatatttcgacaggctcccatatgacgagtagcccgcatttcttccatgtattgtttatacaccggaataaatttagcagtcgttgcgtcatccaatgccaatccttttataatttgattgcactgtatttccagcatctgctctttattaaactgccttctttcagatttagctcctttcttttcttgtgcaaaaagtgttacctgacttcccataacaatggctgccaacatcattaaaaaaaattttgttctcatcatttttttgtttttagtgattaatcaatttataaatatatcattttcagataattccacccatcctgctaattcctcatcagacatagattctatataacgatccaaagtatctgaataagaagagtctaaatccgtagaaacaataagtgaaggagaaggcaactcctctgccacaggttgggatatcggaaagaaaagaactcccaacatgacagccgcaatagctaaagcagccccaataatcaattttattctatgctgcctattaaacctctcagcctgtgtacgctccaatacttgcttctgcatttttccgaaaaagccatcaggggtacgataaggcatccgcttcccaatattcttaaaatcaaactccttttccatcctgtctttaattatttatcatgtactcttttatcttctcttttgcataatgataattcactttcaacgtatccactttcgtgtccgtaatcctgctaatttcctcatattccagttcatcataataacgaagattgaaaactacccgctgcttttcaggaagcatcaaaatagcctgctgaaatttcaccgccatttcgttctcataatccacataatctgacgccatcaacttattcattaactcttcctgaacttcttccgccgaaacagcttgttccttacgcatattcagaaaacggagacactcattggtcgctatccggtaaatccatgtccccaatgaactttcctccctaaactgaggaagatggcgaaagacgcgaataaagacttcctgcagaatatcctctgcatcctcatgtgatacaaccaatctccggatatgccaatatatgggctgttgaaaaaaatctatcaacagtttaaatccccgttccgggttggaagcccatacttccctaattttatcttcgtttatcatctattcgtcaaaagtttataggttagaaccacccgagaacaagaagttaaaagtgaaaatgaagtttttacattaattatagatgaagttaaaataatcaatcacatttcctacaagagaaaaatacaaccaatcttccggaatatgaatttaaagaattcaaactcaatcttcctatcaataaatttcagttcttagaagaattaccatataaacagtagggaaatccctaaaaataaataggggaaaagatagaagaatataccttttcccaacttatctttgttacaaacaaaaaaacaaaaaaatgagaagattgaaacaaacattattagcgttaaccatttgtactttagtcatcagttgcagtttgactactagtagcactattatgaaagtacagagagggatgtcccaagaagaagtcagccatttacttgggaaacccgatttccgtagattcgacaacggctcggaacaatgggaatataccaagaccaatatgtccacagctgcaaacacggtaattattatcgattttgtagacggaatggtaacaaacatggattcttttgagtccaacattactccgcctccagttgcagtgtgtccgccaaatgaaatcattacggtagttccacccagccaccctgatcattctggcccgcacagaccaaaacacaaagccatgaatccacatgattttgaaaacctctataaaaaagtaaaaaacaaagcatttaaggacgaccaaatggaattattatctgtaggagttgtaaacaactacttcacctgtaaacaaactgcccgactcatgtccatatttacatgggacgatgaaaaaatgaaagtattaagaatggtttccaaccgcattgtagaccgtgaaaatggaaaagaaatcatcaagacactggattctttatttaaacaagatgatgcacgtaaaatattgggaatcactaaccaatggtaattcaacctaaacaacacacaaaaacataaatatatgagaaaattcaaacaactattattgcttgttatcagtataacacttgtcagctgtcataccacaggaagtatcaaacagaaagcatggaaagtacagcagggaatgacaacagaagaaataggccaacttcttggaaaacccgatttccgacgtttcgatggttctttggaacaatgggaatatcagagcggaggaattgcaacgtcttgcaaatttctaattatcgaatttcgaaacggaaaggtaacaagcatggattcctacaatgaaatagctaaagagacttcagtaggagacctatattccagcaaaatatccctcgataccgttggttcaatagacgataacgaatttgaaaagatatacaatgaaacaaaaaattccgtattcaaagattcaactctggaaaaagccattataaataaaaaattaagttgcgcacaatgccttaaacttatgtcactttatacttttgataatgacaagttaaaaatgttacaagtactgaaagaccatatagctgacacaacaaattacgataatattgtcaactcactagatttcatttcaagtaaaaacaaggccaaagagatattaggaataccctaatacagtaaaagcagatgtacctgttgcaataaacctaaaaaatattgcaacaggcacatctgctttacctcaatcttctattctgacagctgtgccgcttgcggttaccatcagcatactaccgctgtcccccacagtttcataatccaaatccaccccaactacagcattagctcccaataaagcagcctgatcctgcatttctcgtaacgcagtatctttagcctgtcgaagtacttcttcataagaaccggaacgaccgcctacaatgtcacgaatactagcaaaaaaatcacgaaacagattagcaccgataatagtttcacctgttacaatgccataatatttagttatacgttttccttcgatagtaggtgttgttgttgctaacataatctttctcttttttaattatatattcattagacgcacaaataaaaaaaaaagttgcaactttctcctttttttatcggtaactatattattcttctcacattcaactccgacaagcaataagaaaacaaataaatttaaaaccagattttagaaaagaaacattgggagattaaaaacaaaacattacatttgcaagaaaacaaagaggaacgtatcatgaaacaaatcaaactggaaataaacatagaggcttgccattatgacgaactaacagagaaggaccgcaaactgatagacgccgcgtgtgaagcaacgaaaagaagctatgctccttactcacattttgctgttggagccgccgcactgttggaaaatgatatcgtcattaccggaaccaatcaagaaaatgcagcctacccatctggtctttgtgcagaacgtaccactttgttttatgccaattctcaatatccggatcaagcagtaaaaacactcgccattgctgcccgcacagaaaatggttttcttgacacacctattcctccttgcggagcctgtcggcaagtattattagaaactgaaaaacgatatggaaaacctatgcggatactgctttatagtaagactgatatttatatattagaaaacgtaagcggacttttacctttatcgtttgatggaaattatctgaaatgatacctaccatccgtctgcacagccaacagttaataaatccggttttcaataatccgaaagatcttgtatcatggatgggaggcattcaagcgcaagattacaccatgtccaaatgggctattggtatccggctaaaggcaggaaatctgcaaacagtcaatgaggcactggcaaaaggagatatattgcgcattcatgtcatgcgtcctacttggcattatgtagctgcagaagatatacgctggatgctgaagctttcatcccgacgcatcattactgccaatgactcttttgccaagtccagaggacaagacatttcagttgacatttacaacaaagcaaaccgattattggaaaaggcactagcaggacacaatcatctgaccaagcaagaaattgacaacatatttaaagaaggagggctggaaaccaatgaaagattatccaaccgtttcctgattcacgctgaagctgaaggacttatttgcagcggagcagataaaaataataaaatcaccttcgcacttttggatgagcgtgttcctccaatacaagaattacataaagaagaggcgctagctatcttggcacgcaagtattttagaagccactctcctgccagtctgaaagactttgtatggtggtccggactttcggtaacggaagctagacaaggtatagccgccattgaacaagaattgcttactgaccgtttcctagcacaaaaattatatgttcatcagtcttataaagaagaaaaaacaaccgacatattgcatattcttccttcatacgatgaatacctaatcagctacaaagaccgtactgatgtattgaacaaagaataccaacacaaagcattcaattctttcgggatattccgtccggttattctgtacaacgggcaaatagttggaaattggaataaagtcatacaaaaacaaacaacacatatagaaatgaactggttcaagaaaaatacaaagatcaaaagagaattactttccctagcggagagaaaataccttacttttttctccgaactgtaagaaaattgtaaatggattatttctgcgtcatcacattttaaaaataatccattacatttacattattcagtattgcaatataaaactctcagccactttcaagaaacgttcatgacctttttcattcaaatgtgcagtatctgtattattcttgctgttctgaaaatatatttttctaaaatgatcattacttgcataaattcctccttttcgggcgctgtcaaaaataggaatactataatttccacaaacctcaatcatagcatccaccactttctcagcatcacttcctgcaaaatttttacagttccatcgggtaaagaaaaaaatcttagctgtgggatacttttcaataagcccttcacacagcattgccagcctctctttaaatacatcaataccgccaattgaatccaatttaaaaccatcattgtgcccacccacaacaataacataatccaaatcatccggcatttccttatatcttacatacatcgcttccccccaacgcgggctactataagcaatgctgctgccgttcttgccataatttaaatattccataccatgtttctcggcaaatttataatgccaggtattcttaacaggttccttatgattcttcacataactatctccaataattcccaaacgttttcctttcaattcatcagtcctgacggtaactcctttaataatttgttccaactgcttatatacctgttgtcccaaatactctgccgaatgagccgtgaaatgaagtctgtcatttaacaattccgcgcctgacatatctatcaggtgcatgttcggatcttcagcagccaattgcttcatcgcattctccacttctctgctgaaatatttattacttcgggcaacagtaccaaaaataaaaggcaaacgagaataatcctttccggttttttctgtcagatgcatacgcacataagccaccattgtcttcaagttacggtaataatctttacttttagcataatcactttccccctgatgccaaagaaatgcatctatctgatagccatccttcaggcgggaaagagtcttgtctatacacatgtctatctcttgaatgaaagaaagcaacaaggagtttcctccatcagaagttggcttagcctgtgccagccattcaggcgccgcagaccaaaaacgtcccttggaagcattataatcaggtgctatggaagttccgccaacagcccatttcaccacataaaatttctcctgcaacaactgctccaaccaataatatgtcactgcatcaaaagcccacatattattttttccgctacgtttggcacgaggccagaaaggaataaattctccctttccgtcattctgagctatctgacaataacggtaggcaccttcggcatacgtcagtgtatccgtagccaatgctttaatatatgccggcaaatcttcattaggagttcgtccatcggtattagactgtccggcagttataatcacatgtacaggattggaagccatcgtattcaagccaacagctgcaaaaatcaaaatcaaaattaagtttttcataagtatcatttcatgtttttaatggacacaaaaataatcctaattctaatataacgacatggattatcgtccattatcatagattttttgaactcattatggttcatacagaatgagaattgcggctaaaccataaaaaaagagccacaggaacaatggctcccaatgactctttctttttcagctcatatttataatttaattatctccatacatacgcgcacgcatttctttaatatgatcagaagtgatgtattcatcgtattccatcatcttgtcaatgataccattcggggtcaattcaataatacggttcgccaccgtttcaataaattcgtggtcgtgggaagagaacagcacatttcccttataagtcttcagattattattgaaagcctgaattgattccaagtccaaatggttggttggagtatccaaaatcagacagttcgcattacgcaactgcatacgggcaatcatacaacgcatcttctcacctccggaaagcacattcactttcttcaatacttcctctccggaaaacaacatacgccccaagaaacctttcatatagacttcgttaccttcgccaaactggctcagccaatctaccaaattcaaatcactttcaaagaaatccgtattatccaaaggcaaataagctgtagtaatagtaacgccccacgcgaatttaccagcctgcggagtacgatttccattgattatttcaaaaaaagcagtcatggcacgcggatcacggctcaaaaagacaatcttatctcctttttctacattaaaattcacatcattgaacaataccataccgtcttcagtttccgcacgcaagccggatacttccaaaatctgattgcccggttcacgatccggagtaaagatgataccgggatatttacgggacgacggcttaatttcatctacattcagtttttccaacatcttctttcggctggttgtctgcttgctcttagccacattggcactaaaacgacggataaattcttccaactctttcttcttctcttcagctttagccttctggttctgctgctggcgaagtgccaactgacttgattcataccagaagctatagttaccggcaaacatattcactttaccgaaatcaatatctacagtatgagtacaaacagagtccaaaaagtgacggtcatgacttaccaccaacaccgtgtgctcgaaattagaaagatattcctccaaccaagtcaccgtatccatatccaaatcattggtaggttcatccaacaacaagttatcaggattaccgtaaagtgcctgcgccaacatgacacgcaccttttccttaccgctcagttcccccatcaacatatagtgcttgtcttcctttatgcccaatccgctcaacaaagaagcagcatcactctcggcattccaaccatccagttcggcaaacttctcttccaattcagaaactttcaagccatcttcatctgtaaaatcagttttcgcatacagttcttcacgctgtttcataatgttccacaacacagtatgtcccatcataaccgtatccatgactgtatattcatcccacttaaagtgatcctggctcaatacagacagacgttcgcccggtcctaataccactgagcccttagtcggttccagctcacctgaaattgctttcaagaaagtagattttccggcgccgttcgcaccgataaccccgtaaatattaccattggtaaacttcatatttacgtcattatacaacactcttttaccaaattgaatggccaagttcgaaactgtaatcatcctaatataccttatttatataattattctattttggaattgcaaaggtaggcattttaattcagaaaagtatgccagtgtggcagaaattccgtacttttgcaaaattattactctaagaaaacaactaggcacgaaatttgttagcagtaaattaacctaaaagacctgactgttatgagtaaaaataagaaaaacaaaaagtttaataagaatatgaacccaacagagaagaaccaacctcaagacgaggaagttttgaaaaatcaggaagcggcagaagctgccattgatgaagaaactcagaaagaagcaacagaagaactgaacgctgaagagaaggtgaacaaggaattggcggaagctcagaaaacaatagaagagcagcatgacaaatacctgcgtctttcagccgaatttgacaattaccgtaaacgcaccatgaaagagaaggccgaattgattaagaatggtggagaaaaggccattactgccattcttcctattttggatgacttggagcgtgcagtaaagacttcagaaacttcggatgatgtaaaagcaatgcgtgaaggaattgagttgatctacaacaaattcctgaaagtattgaaccaggaaggacttcagaaaatagaaactgacggtgagaactttgataccgattatcacgaagcaattgcattagttccagctccttccgaagagaagaaaggaaaaatattggactgtgtacaaaccggttataagctgaatgacaaagtaatacgccacgccaaagtagttgtggctcaataaaacagtatcataaaacgacatggcaaaaagagactattacgaagttctggaggtggacaaaacagccacccttgatgttataaaaaaagcataccgcaaaaaagcaatacaatatcatccggacaagaatccgggagataaagaagcggaagaaaaattcaaggaagctgccgaagcttatgatgtgttgagcaacccggataaacgcgcccgttacgaccaattcggacatgcaggaatgagtggagctgccggtggcggttttgaaggattcggacaaggtatgtccatggatgacattttctctatgttcggtgacatcttcggtggacatggaggaggtttcggaggctttggaggtttcggcggtggcggacgttccgcacaacgcaagttccgtggttcagacctccgtgtaaaagtaaaactgaacttaaaagaaatttctacgggagtagaaaagaaattcaaactgaaaaagtacgtaacatgtgaccattgccatggttcaggagccgaaggagaaggaggaacggaaacatgtcccacttgtcatggaacaggaagtatcacccgcacccaacaaagcatttttggaatggtacaatcacaaagcgtatgtccacaatgtaacggagaagggaaaataattaagaacaaatgtaaagcttgtgcaggagaaggtattgtatacggagaagaagtcgtggaagtgaaaattcctgccggtgtggctgaaggaatgcaactttctgtcaatgggaaaggaaatgcgggcaaacataacggtgttcccggtgatttgcttgttgtcatagaagaagaatcccatccagacctaatacgcgatgaaaatgatttgatttacaatatgttactaagcgttccgactgctgctttaggaggcactgtagaaataccaactattgatagcaaagtaaaagtaaaaattgaaccaggcacccaaccaggtaaggtcttacgcctaagaggtaaaggattgcccaatgtcaatagttatggttacagtaacggtacaggtgatttattagtcaatgtaagcgtatatattccagaaacgttgaataaagatgaaaaacaagcactagagaaaatgcaagaatcggataacttcaaaccgaatacaagcattaaagaaaaaatattcaagaagttcaaaaacttcttcgattaatttttatactacaaagtgtcacagaaagaatatcaggttttatatctgcctggcattcttttgtgacactttgcggtaaataaaaacatttgccatgaattacgaagaaacattggattatttatataatagtgccccattattccaacatataggaaaagatgcatacaaggcaggattagaaaacacttatcttttagacaagtatttcaaccatccccatcgccaattccgaaccattcatatagccggaaccaatggaaaaggctcttgttcacatactttagccgccattttacaatcagccggatacaagacaggactttacacttctccacatctgatagatttccgtgaacgaatccgcgtcaacggaattcctgtatccaaagaatatgtcatagactttgtagaaaaacaccgtgccttttttgaacctttgcatccttctttctttgaactgactaccgcaatggctttccactattttgcccaaagccaagtagatgtagccattatagaagtcggtctgggaggacgaatagattgtacaaacatcatccgtccggatctatgtgtcataaccaatatcagtttcgaccatatacaattcttaggtaacacattagccaaaatagccacagagaaggccggaatcatcaaagaaaagaccccggtagttatcggtgaaaccacacccgaaaccaaacctatatttacaacccgtgctaaagaagtaaacgctcctatctactttgcagaagaagaacagttattacactcctccagcataaatgaaaaaggtaaacgaatatatcacacaaccgactacctcaatctggaaggcgaactggaagggctttgccaacttaaaaacaccaatacacttttatctgccatccgcctattaaaacaagcaggttatcaacttaccgaaagcaatatacgcaaaggattctcacaagtatgtgaactcaccggcctgatgggaagatggcaaaaattagaaagtgaaccgactttaatatgcgatacaggacataatgtaggaggtatttcgtatatcatagaacaattaaaacatcagaaatatgaacgattacacattgtaataggtatggtaaacgacaaggatatcagtggagtattgtccatgcttcctaaaaatgccacctattattttaccaaagccagcgtaaagcgtgctttatccgaaaaagaattacaaagtttagcgatgcaatccgggctgcacggagatacttatcctgatgtagaaacagctgtaacagccgctaaagaaaaggctaacaaaaatgactttatttttgttggaggaagcagctttatcgttgcggatttattaaaatttcacgtttagtccgttcacttttatagaaaaagtttgggaataccgaagaaaatctttttatttgcattagttttatacataaaataaaaagattttcaataacatgataaacacatctacttccgatgagaatttatgcggcctgaaacgggccgattttcagacaacagtgaacgggaaacaaacagacctcttcattctgaaaaatgaaaacggagctgaaatagctgtcaccaactatggtggagcagtattagctattatggttccggacaaaaacggtaaatatgccaatgtcattcaaggacatgatagtataacccatgttatcaatagccacgaacctttcctcagtactcttatcggtcgttacgggaaccgtatagcaggaggcaaattcattttagaagggaaagaatattcactgactatcaacaatggtcccaactcgctgcatggcggtcctaccggatttcatacccgcatttgggatgcagaacaggaaactccccaaagtttgaaattgcattatttatctgctgatggcgaagaaggatttccgggaaatttggatattcacgtaacgtacactttaagtaatcaaaatgaattcatcattacttaccacgctacaacagacaaaacaacattggtaaatcttactcaccacggttttttcagcctatcaggcattgccaatcctacggcaaccgttgataacaacatcgtaaccattaatgctgatttttatactccgatagataatgtatccatccctacaggcgaaattgccaaagtagaaggtactcctatggattttcgtactcctcaaagagtagacagtagaatcaatgacccattcgaacagctagaattcggtgccggctatgaccactgctatgtattaaacaaacgtgaagcaggcacactgagttttgcagcaaaatgtgtggagcccgaaagcggtcgtagcatggaagtatacactacagagcccggtgtacaagtttatacttcaaactggcacaatggtttcgaaggtgctcatggagcaactttcccagcaagaagtgccatctgttttgaagcacaacattttcctgatacgcccaataaaggtcatttcccttcttgcgttctacatccgggggaaacttacagccaagtaaccatctacaaattcggtgtagaaaaataattttatgaaataacctaattaataaacttataattttttcaaaaccatgaatcaacaaaaacagaacggtaatatcatcgctatcattacaatgttcttccttttcgcgatgatttccttcgttactaatcttgctgcgcctttcggcacaatatggaaaaaccaatatgcaggtgccaataccttgggtatgatgggaaatatgatgaatttcctcgcatatctgtttatggggattccttcaggtaatatgcttgtaaaaatcggatataaaaaaacagccctcattgccatggcagtaggtttcatcggtttgtttatccaatatatttccagtttgttcggtgcagatatagacgtattcaatttaggagaatatgccattaaaatgaattttatcatctacctgcttggtgccttcgtctgtggtttttgtgtatgtatgctgaacactgtagttaacccgatgctaaatcttttaggtggtggtggtaacaaaggtaaccaattaatccaagccggtggtgctctaaactcattgtcaggtactttgactccgcttttcgtaggtgccttgattggttctgttacccctcaaacagctatgtcagatgtagctcctctgcttttcatagcaatgggtgtattcgtatcagcgtttatcgctctttcattcatcgccattccagagcctcatctaagaaaagcaggtcatgaaaaagagaaattctctcatagcccttggaatttccgccatactgtattaggtgtaatcggtatctttgtgtatgtaggtattgaaatcggtattccaggcacattaaatttctatcttgccgacccaacggaaaaaggtgcgggcctgcttgccaacggtgccgctatcggtggtgctattgctgccatctattggttgctcatgttagtgggacgttctgcaagtagtgtcatcagcggtaaagtagctacacgtacacaattgattgttgtttccgcaacagctatctgttttatattaatcgcaatcttcactccaaaagaaatcactgtctctatgccgggatatagtgtagaaaatggattcgaaatggcctctgtacctgtcagtgccctatttttggtactttgtggtttatgtacgtccattatgtggggaggtatcttcaacctcgctgtagaaggtttaggcaaatataccgcacaagcttcaggtatttttatgatgatggttgtcggtggcggtattttcccattattgcagcaattcatttctgacgctgtgggatatatggccagctattggttaattatcgctttgcttgcttatctgttgttctatggtttggtaggatgcaagaacgtaaacaaagacattcctgtagaataattataaaaacatatagtattaactttaaactattaatatcatggatatagaatacgtaagaagtcgcttcatcaaacattttgatggcacaacaggttcagtatatgcatcacccggacgtattaaccttattggagaacataccgactataacggtggttttgtctttcccggagcagtagataaaggtatgattgctgaaatcaaacctaatggtactgataaggtacgtgcttattctattgatctaaaagactatgtagaattcggcttgaacgaagaagatgcccctaaagccagttgggcaagatatattttcggcgtttgccgtgaaatgatcaaacgtggtgtagatgtgaaaggttttgacactgcttttgcgggtgacgtacctttgggtgcaggtatgtcttcatctgctgcattggaaagtacgtatgctttcgctatcaacgaacttttcggtgacaacaaaatagataaatttgaattagccaaggtaggtcaggcaacagaacataattattgtggtgtaaattgcggtattatggatcaatttgcatctgtattcggaaaagaaggtagtttgatccgtttggactgtcgctcattggaatatcaatacttcccgttcaaaccggaaggttaccgattggtattggttgactcggtagtcaaacacgaattggcttcttctgcttataataaacgtcgccaaagctgcgaagctgctgtagccgccatccagaaaaaacatcctcatgtagaatttttacgtgattgtacaatggaaatgttgcaggaagcaaaagccgagatcagtgaagaagactatatgcgtgcagaatacgtcattgaagaaatccaacgtgtacttgatgtttgcgatgctttggaaagaggtgattacgaaaccgtaggacagaagatgtatgaaactcactatggcatgagtaaattgtatgaagtaagctgtgaagaacttgacttcttgaatgatgttgctttcgactgcggtgtcaccggttcacgtgtcatgggtggaggtttcggtggatgtacaatcaacctagttaaaaatgaactatacgaaacattcatcaccactgccaaagaaagattcaaagagaagttcggaagaagtcccaaagtttacgatgtagtcatcagtgacggttctcgcaagctggtataaaaaagatctcaaattcgctaacatatgaaaaaaccgctttggattcaaagcggttttttcttctttatgctataaaagtgtaggaaatacacttttatgttgcacaacatactcttttcatatccaatgtattagtaatagtgttacttttacacccaaaatcatatactctattactaattagtacttttatatcatgaaaagcatgaaaaaaacctttctgggaaccggtatcgcactgaccttgttaagtgcttgcgctcccaaacaatctcaagaaacacttacaaagtccggattaaaccccactaattatgaaacaatagtggatggcgtaaaacctgtcaaactgtatacgctaaagaatgcagccggaatggaagtatgcgtaactaattttggcggacgtattgtatctatcatggtccccgacaaaaatggaaatctaaaagatgtagtgctgggttttgacagcattgctgactaccaaaatataccaagcgacttcggtgcttctatcggacgctatgccaaccgcattaataaaggagtcatcgtaatggatggagaaaccattcaattaccccaaaataattttggtcactgcctgcatggaggtcctaaaggatggcaataccaagtttatgaagcaaaccaattaaacgacagtactatgacactgactatgaagtcaccggatggagatgccaattttccgggaaatgtaaccgctactgttacttatgcactgacaagagacaatgccatcgacataaattacgaagcgacaactgacaaaaagactgttatcaatatgaccaaccactcttatttcaacttgagtggaaaccctgccaatccggccaccgaccatattctttatgtaaatgcagacagcatcactcccgttgacagcacattcatgaccactggagaaatgatggcagtaacagaaactccatttgatttcaatactcctaaaaccattgcccccgatgtgactaactttgaaaacgaacaaataaaattcggtaacggattcgaccataattgggtacttaacacgaaaggcgatatcaaccagctggctgccaaactgaccagccctactagtggtatcactttggaagtatatactaatgaaccgggaatacaagtttatacaggcaactttttggatggaaccgtaaaagggaaaaagggaattacttatctgcaacgcgcgtctgtttgtctggaaacacagcactatcccgacagccccaacaaatcacaatggccttctgtaattctggaaccgggacagacctatcacagccaatgtatctttaaattcggtgttgaaaaataattgttaaactttaaatatttaatatcatgaattggaattcacatgaattcatctggctggactggacaatactggcagtcggcattgtagctgtgatatgggcggtatggcgctctgtacaaaaagacaaacgctcgcaacaaggagcaagcagtgaagattatctatttggcaaaggtgagccatggtacatcattggtgctgctatctttgcagccaatatcggttcggaacatctggtaggtttggcaggaaccggtgccaaatccggagtaggtatggcacactgggaaatgcaaggttggatgattcttcttctaggatggctttttgttccattctaccaactattaaacaataaaatgggcaaaatcattaccatgcccgatttccttaaataccgttataccccgcgtaccggttcatggctttctatcatcacactgatagcctacattcttactaaagttagtgtaaccgcctataccggaggtatctttttggaattcttacttggacttcctttttggtatggggcaatcggacttattgtcctgaccggcatcttcaccgtactgagtggaatgaaaggagtaatgaccctctcagctattcaaacccctattttaatcatcggttctttcttggttcttttcctgggactgtcagccttgggagacggtaatattgctacaggatggacagaaatgatggatcatgcgcgtagcgccatgaatgtaggagcagacggacacgcttatggtgccaaccatatgtttcactggaccgaagcagacccgatgtatcaagattatcctggattctgggtatttatcggagcttccatcatcggtttctggtattggtgtaccgaccagcatatcgtacagcgtgtacttggacagcgtaaaggcgaagataatgatgtggtaatgaagcgtgcccgcagaggtactattgcagccggttattttaaaatcctgcctgtcttcatgtttcttattccggggatggtagctgccgccttggctgcaaaaggtgaatttgatatgtcaaatacagatgcggcttttgctgtaatggtaaaggatgttctgcctgccggtgtaaaaggtattgtaactatcggattcatctgcgcattggttgcttcactggctgctttctttaattcatgcgccacactttttacagaagacttttacaagcccatgtttaaaaacaaaagtgaagctacttatgttatggtaggacgtatcgccaccgtagttgtagttatcctcggcatggcatggattcctgtaatgatgagcctcggcagcctttacgactacctgcaaggcatacagtccctccttgcacctgcaatggtagccgtatttgcacttggtatattctccaagaaaatcactccgaaagccggtgaaacagccatgattgtaggtttcctaattggtatgctccgtttgctgactaatatcctcaccaataccggaaaagatgtgatgaccggctggttttgggaaaatacaacttggttttggcagacaaactggcttatttttgaaatatggctacttgtattcctcttgttgttaatggttgttgtatcatgcttcactccggctccaaccgccaaacaagtggaagccatcacctttaccggcagttacaaggaacttatcagaaagagttggaacaaatgggatgttattacctctttaggtgtagttctgctttgtgcactattctatgcttatttctggtaaaccataaattaaaggctgtatgctttgaattatcttgaagaatacagcctgttaattttaaaccgacgctaaaccatgaccacctattataacataaaccctaaattctatgtatctgtagactgtatcattttcggttttgacgaaggagaattaaaactgcttctactaaaacgaaattttgaaccggctatgggaaaatggtctttgatgggaggattcgtacaagaagacgaaagtgtagacgctgccgccaaacgggtattggcagaactgaccggattggaaaatgtatatatggaacaagtaggcacatttggcgacttagagcgcgatccgggagaacgagtcatatcagtagcctattatgctttagtcaatgtaaatgaatatgacagggaactagtgcagcagcacaatgcccattggacaaaaatagacgaactgccacagctcattttcgaccatccgatcatgatttccaaagcacgtgaactgatgaagcacaaagcatcatacaatccaattggttttaacctgctgcccgaactgtttaccctgacacagttgcaaaatctatatgaggcaatctatggcgaaccgatggacaagcggaatttccgcaagcgggtagccgaaatggatttcattgaaaaaacagatttgatagacaaatcaggttcccgacgaggtgcttatctttataaatttaatgataaggcctacagaaaagatccgaaatttaaactttaaaataatgtgccgatgcaataatttgccaattgacaaattagcagattgccacattacccaattattcattatgttagaaaaattaaaagaaaaagtattccgtgccaatctggatttggtgaaacacggactagttatttttacatggggaaatgtttctgccatcgatcgtgaaacaggtctggtagtaatcaaacccagtggcgtatcatacgatgatatgaaagctgaagacatggttgtagtagatctggacggcaacgtggtagaaggttctcttcgtccgtcttcagatactcccacccatgtagttctatataaagcattccccgaaataggtggagtggtacatacccactccacctatgctaccgcctgggcacaagccggaatggatatccccaatatcggaacgactcatgccgattatttccatgacgccattccttgtaccgcagatatgactgaagaggaagtaaaaggtgcctacgaacaggaaacaggcaatgtgattgtgaaacgtttcaagaacctgaaccctgtacatactccgggagtactagtaaaaaatcatggtccttttgcatggggaaaagatgccaatgatgctgtacataatgcagtagtcatggaacaggtagccaaaatggcaagtatcgcttttgccgccaaccctcatttaacgatgaattctttattaatagaaaagcatttcagccgcaaacacggccccaatgcctattatggacagaaataagaaacaaagaaattaataacccttttaaaatataacattatggaaaaagcatttgatcagtatgaagtatggtttgtaacaggagcacagcttctgtacggaggtgacgcagttatagcagtagacgctcactccaatgaaatggtaaacggactgaacgaatcagggaaacttcctgtaaaagtagtatataaaggaacagccaactcttctaaagaagtggaagcagtgttcaaagcagccaacaacgatgaaaaatgtatcggtgtcatcacttggatgcacactttctccccagctaaaatgtggattcacggtctgcaacagttaaagaaaccactgttacatctacacactcaattcaataaggaaattccttgggataccatggatatggacttcatgaatctgaatcaatccgcccatggtgaccgcgaattcggacatatctgtacccgtatgcgcatccgccgcaaagtagtggtaggttactggaaagacgaagacacccagcacaagattgccgtttggatgcgcgtttgtgcaggttgggcagactctcaggatatgctgatcatccgtttcggcgatcagatgaataatgtagctgtaactgacggtgataaagtggaagcagaacaacgtatggggtatcacgtagattactgtccggcaagcgaactgatggaataccataaaaacatcaaggatacagatgtagaggcacttgtagcaacttacttcaacgaatacgaccacgatgcttcattagaagataaatcaaccgaagcttatcagaaagtatggaacgctgcaaaagccgaattagctcttcgtgccatccttaaagccaaaggcgccaaaggattcactactaattttgatgatttgggccaaacagacggcagctacttcgatcagattccgggactggcttcccagcgtctgatggctgaaggctacggattcggtgcggaaggtgactggaaatcagcagctctctaccgtaccgtatgggtgatgaaccaaggactttccaaaggttgttctttcctggaagattacacattgaacttcgatggtgcaaacagtgctatcctgcaatcacatatgctggaagtttgtcctcttatcgccgcttccaaaccacgtctggaagtacacttcctaggcataggtattcgcaagagccagacagcccgtcttgtattcacttcaaaagtaggctcaggttgtaccgccactgtagtagacttgggtaaccgtttccgtctgatcgtgaacgacgtagaatgcatcgagccgaaaccgttgcccaaattaccggttgcttccgccctgtggattccgatgcctaatttcgaagtaggtgcaggcgcatggatcctggcaggtggaacacatcattcttgcttctcttatgatctgacagcagaatattgggaagactatgctgagattgcaggtatcgaaatgatccgtatcgacaaagatactaccatcagcaacttcaagaaagagcttcgcatgaacgaagtctactatatgctgaacaaagcactttgctaattcatccatgaagaggggatgtgtcaaggctaataagattcttggcacatcccaccttattttatcatcattattgttgtaccttaaattataggttttaatatgaaatcagatgcaaaatcaaccatcgaagcaggaaaagctattctaggcatagaattcggatcaacacgaatcaaagctgttttgattgaccaggaaaacaagcccattgcccagggaagccatagctgggaaaaccaactggtagacggactgtggacttacagtgtggaagctatctggcatggcttgcaagactgctatgcagatctccgttccaacgtaaaaaaactatatgacacagaaatagaaaccttggcggcaatcggtgtcagtgccatgatgcatggttatatggcattcaataaagaagaagaaatccttgtacctttccgtacatggagaaataccaataccggtccggcagccgccgccttatctgaattattcgtatataacattcctctgagatggagcatttctcatttataccaagctattttagacaatgaagaacacgtaagtaacattgactatctgaccacccttgcaggtttcattcattggcaaattacaggtcagaaagttctgggcataggtgatgcatcaggaatgcttcccatagacccggctaccaagaattattctgccgaaatgatagccaagttcgacaagttggtagctcctaaaggatacccttggaaactgacagatatcctgcccaaagtcttacccgccggcgagaatgcagggttccttaccccggaaggtgccaagaggctggacgtgtcgggccacttgaaagcaggtgtacctgtctgccctccggaaggagatgccggaaccggcatggtagcaaccaacgctgtcaagcaacgcaccgggaatgtatcagcaggcacttcctcattttccatgattgtattggaaaaagagttgtccaagccatacgaaatgattgacatggttaccactcccgacggaagccttgtagctatggtacattgcaacaactgcacctccgacctcaatgcctggatcaatctgttcaaagaataccaagaactgctgggtatacccgtagatatgaatgaattatatggaaaactttacaatcatgcgctcgcaggcgatgcagattgcggtggtcttatttcgtataattatatttcaggtgaacccgtgacaggacttgccgacggaaggccattgtttgtacgttctgcaaatgacaaattcaacctcgccaactttatgcgtacccatttatacgcttcagtcggagttcttaagataggtaatgacattcttttcaatgaagagaaaatcaaagtagacagaatcacaggacacggcggattattcaaaacgaaaggtgtaggccagagaatacttgcagcagctataaactcccctatttccgtaatggaaactgccggtgaaggtggcgcatggggaatcgccctgctaggttcttaccttgtcaacaatgaaaagaaccaatccctggcagattttctggaagacaaagtattcgccggtgatgccggtattgaaatatcgccaacagccgaagatgtagccggattcaacacatatatcgaaaactataaggcaggattgcctgttgaagaagcagcgacccgatttaagaagtgagtcaaacgggcttaaaaaagagcctctttacatgttgcggtttacacataaagagttatctttgcagatattaaataaaatagcaaagataaaccgactcactaatagcattcaaattataatattattttaatatgaacgaaaagaaacttatgaaccgtgcagcggacaacatccgtattctggctgcttcgatggtagagaaagctaattcaggacacccgggtggagctatgggtggcgctgattttgtaaacgtgcttttctctgagtttttagtttacgatcctgaaaatccgcgttgggaagggcgtgaccgtttcttccttgatccaggccacatgtcaccgatgctgtattccactttggcactgaccggcaagttcaccatggaagaactggcacagttccgccaatggggcagtccgactccgggacaccctgaagtggacatcatgcgcggtattgaaaatacttccggcccgttaggacaaggacacacttttgcagtaggtgctgctatcgctgccaaatttctgaaagcccgtctgggtcatgtcatggaccagaccatctatgcctatatatccgatgggggtattcaagaagagatttctcagggtgcaggccgtctggcaggtcatttggggctggacaacttgatcatgttttatgattcaaacgacatccagctgtctaccgctaccgatgctgttaccagcgaagatgttgccaagaaatacgaagcatggcactggaaagtaattaccatcaacggtaatgatcccgatgcaatccgcacggctctgacagaagcgaaagccgtaaccggtcagcccacattaattatcggtaagaccattatgggtaaaggcgcacgcaaagcggatgattccagttatgaacgtaactgtgccacccacggtgctcctttgggaggtgatgcttacatcaatacaatcaagaacttaggcggcgatccaaccaatcctttccaaatcttccctgaagtaaaagagttgtatgccaaacgtgcagaggaactgaaaaaaattgttgcagaaaaatatgcggctaaagctgaatggactaaagctaaccccgaactggctgctaaattggaactatggttctctggcaaagctccgaaagtaaattggaatgttatcgaacaaaaagccggagatgctacacgcagcgcttctgccaaagttctcggtgtactggctacagaagtagaaaacatgatcgtttcttctgccgacctgtcaaattcagacaagaccgacggtttcttgaagaaaacacatgcattcacaaaagacgacttcaccggtgcatttctgcaggcaggtgtttccgaattaaccatggcttgctgctgcctgggtatggcacttcacggaggtgtgattgctgcatgcgctaccttcttcgtattctcagactacatgaaacccgccatacgtatggctgccttgatggaacttcccgtcaaattcatctggacacacgacgcattccgtgtaggtgaagacggtcctactcacgaaccggtagaacaagaagcacaaatccgcctgatggaaaaactgaaaaaccacaaaggacacaattctatgttggtactccgtccggcagatgcggaagaaaccactgtggcatggaaattggccatggaaaataccagcacccccaccgcactgatcttctcccgccagaatatcgcgaatctgcctgcaggaaacgactactcacaggctgccaaaggcgcttatattgttgcaggctccgatgaaaatccggatgtaatcctagtcgcttcaggttccgaagtttccactttggaagcaggtgcagaacttctccgcaaggatggcataaaaatacgtatcgtatccgctccttctgagggattgttccgcagccaaagcaaggaataccaaaacagtatcattcccacaggggctaaagtattcggtctgactgccggtcttcctgtaaaccttgaaggtttggtaggtgccaacggtaaggtattcggtctggaatcattcggattctccgctccttacaaagtattggatgaaaagctgggctttaccgcacagaacgtgtataaccaagtaaaagaaatgctggcatgaaaaaagtaggactggcatccgatcatgcaggatttgaactgaaagagtttgtaaagacatggttaactgaaaaaggctatccatgcaaagatttcggtacatacagtacagaaagctgtgactatgcagattatgcccatccgcttgcactggctatagaagccggagaatgcggacccggagtggcaatttgcggaagcggtgaaggcatcagcatgacattgaacaaacatcagggtatccgtgcggcactatgctggatgcccgagatagcccatctgtcacgtcagcacaatgacgccaatgttctggtaatgccgggacgattcattgaccatgaaatggccgaaaaaatattggatgaattctttaacagcggcttcgaaggcggacgtcaccaaaagcgcattgaaaagatacctgtaaagtaaaattcacgcaataataataaaagtaaaaaaagagaggcattatagcttctctttttttttattcctatctttgcttagattaaaatataaaataaaaaatattactatgaagaagattctttttttaatgctcctatgtctgccattcatcgctatggcacagacagatcccaaatatctggcgggagcgataactatggatgacggtaaagtttctttcaaaacagagatacaggcaccgtctttaacgaaagaccagctatatggcaccatgctgaaatgggccacagaacgtttcaagcccgaaggcaagttcaatgcacgtgttctttacaccaatgaagatgaaggaaccattgcagcaggtggcgaagaatatctggtattctcctcctctgcattgtcattggacagaaccagaatttattatcagttgtttatcacctgcgaaaacggaaaatgtgatatcgaaatgacccgtatccgttattggtatgatgaagctcgtgacggaggagaaaaatacagtgcagaggaatggattgtagacgatatggctttaaacaaatcgaagaccaagctggctcccatctgcggcaaattcagaagagagactattgacttgaaagacacactgttcaaatccatccaagatacattgggcaacaaggtcttgaacaactcacaaattgcagttgctcctgctccgggcgtgacagctactccgatatcaaatgcaacaacaatcgttaccgccactccggtaactccccctgcccaaccggctgtcatcggtggttctgagggtaataccgaaataaaagcagccaataatgcaactcccagcaaagaacaaagcatagatgaccaaatcaaggcatcctcacgtatgacaattactgccggaaacgatgaacaattcgaaatcggtaaagaatgctggggaggtttcggccagttattcggcaaagaagtagcattctgcgtaatcgaccaagccaaatcaatgggcaatatgctgatggatcagagcgataattataaaatttcgttctacaagcaaggtaatagcgagccgtggttgatagtaaactgcaagaaactgatgaaacagaccgttaccggtgaggaagcaaaaaagatgaatcccagtaatgacggtcagaaggcatataatatgtatgtaggtgaagtaataaaatagtcttttctcccatatatttataccgtgacagtttattctgataatacataaaactttttttagggggagataacctgacaactccccctaaaaaacatacaaacgatctaccatatacttccccaaaagcaccatgacaaataccattcaaacatgtctcccctttaagaataaataacaccgttcctctatcaaccgtttcacttgaaaccatttctataataatcaaaccattagaagaaatcattcttccattttttccctatctttctctcctttttttaaatgtttttagcaagaaagccgttttttctgctccaatcttccctttcataacaaataaagagtatctttgtaaacaacaatgagacaatcatgccttatgacggaacaattacaggacataaagacacttatcgaacagggtgatacggaaagagccattcatgcgctaactaatttcatccgaaacgatgcgcacgtcaacgatgaaccctattacttactgggtaacgcctaccgcaaaatgggagactggcaacaagctttgaacaattatctggaagccatcgagcgtaatccggaaagtccggccgtttccgcccgtgacatgattatgaatattctgaatttctataacaaagacatgtataatcaataataactaacccatggcaaagattaaaggtgctattgtagtagacacagagcgttgcaaaggttgcaatctatgtgtagtggcatgtccgctgcatgtaatcgcgctcaatgccaaacaagtgaataaaaaaggatacacattcgcccaccaggtattagaagatacctgcaatggttgcgcatcatgtgccacagtctgtccggacggatgcatcactgtgtataaagtaaaacaacaataaatgtaacaaatatggcagaagaagtcgttttaatgaagggaaatgaagccatagcccacgccgctatccgtatcggagtagacggttactttggctatcccatcactccccaatcggaaatattggaaacgctggccgaagagaaaccttgggaaactaccggtatggtggtgttgcaggcagaaagtgaagtcgcagcaatcaacatggtatatggcggtgcagcgagcggtaaaatggtaatgacctcatcctccagtcccggcgtcagtttaaagcaggaaggcatctcgtacattgccggtgccgaactcccctgcctgattgtcaatgtcatgcgcggaggtcccggattaggaaccatccaacctagtcaggccgactatttccaaacagtgaaaggcggcggtcacggagactatcgcctcatagccctggctcctgcatcagtacaggaaatggcagatttcgtaggtatagcttttgatctggctttcaaataccgcaatcccgccattattctggcagacggcgttatcggacagatgatggaaaaagtagtattgcccgaacagcgcacacgcctgacagatgaagaagtcatagcccgttgtccgtgggccactaccggcagaacccaccaccgtactcccaacatcatcacctcattggaactcgatcctgccgaaatggaaaaacgtaatatccatcttcagaaaaaatatgcagaaatagaagaaaacgaagtacgtttcgaagaacttcactgcgaagatgccgaatatttgatcgtagctttcggttcttgtgcccgcattgcccaaaaagcaatggaaatggctcgggaagaaggcatcaaagttggtttgctccgtcctattaccctatggccgttcccgtcgaaagctattgcagcacgcgccgcacaggtaaaaggtatcctcactgtagaattgaacgccggacaaatggtagaagatgtccgtctggccgtagaatgcaaagtgcctgtagaacacttcggacgtctgggtggtattgttcccgatccggatgaagtaatcactgcactgaaagagaaactaataaaataagaccgtatgaatatcgatctgatcagaaacatattgaacatacttttcatggcactggcactagcggctgtcatcacttacttcatggcaagtgacttcaaagtattcatctatgtctgtgcagcagctatttttctcaagctgatggaattctttatgcggttcatgttataagcaataggaggagaaactatgacaaaagaagaaatcataaaacccgaaaacctggtttataagaaaccgacactgatgaatgacaatccgatgcattactgccccggatgcagccacggtgtggttcacaagttaatagccgaagttattgaagaaatgggcatggaagataagacaatcggtgtgtcaccggtaggatgtgccgtttttgcatacaactatctagacatcgattggcaagaagccgcccacggacgcgcaccagccgtagctaccgccatcaagcgtttatggcccggacgtctggtatttacctaccagggagatggtgacctggcatgtatcggcactgccgaaaccatccatgctttaaatcgtggcgaaaacattactatcatctttatcaacaacgccatttatggaatgaccggtgggcaaatggctcctaccacgctggttggcatgaagacagccacctgcccctatggtcgtgatgtagccattcatggctatccgctgaaaatgacagaaattgccgccactttggaaggcaccgcctacgttacccgccaggccgtacatacggttcctgccatccgcaaagcaaaaaaggctatccgcaaggcattcgaaaactcaatgaatggcaaaggatccaatttggtggaaattgtatcgacttgtaattccggttggaaaatgactccgcaagcatccaatgactggatggtggaacacatgttccccttctatccgctgggtgatttgaaagataaagaataaaaagacagaaaccatgaaacaggaaatcattatagcaggattcggcggtcagggtgtgctatccatgggtaagatacttgcctattccggactgatggaagacaaggaagtaacctggatgccggcatacggtcccgaacaacggggaggaaccgctaacgtaacggtgattgtcagtgatgaacgcatctcttcacccattctcagccaatatgacacagccatcatactgaaccaaccctcattggaaaagtttgaaggcaaaatcaaaccgggtggtatcctcatttatgacggatacggaatcatcgagcctccgacacgtaaggacatacaaatctatcgtattgacgcaatggatgccgccaacgaaaaaggaatggcaaagaccttcaatatgattgtcttaggaggcttgctgaaactgcgtcccgtagtatccattgaaagtgtaataaaagctttacgcaaaacattgcccgaacgtcaccatcatctgataccgatgaatgaagaagccatccgaatcggaatggagattattaaacctcagtaagttaaaataactctaaacgaataataaaaggaagaactttccatagcggaaaagctcttccttttatttttatattgtatctttgccgccgttatgaaaagaatattctctattatttttttattattcctgtgcttccatacttccttgatggcacagcggacaatgaataccctgaacaatcagttcggttcctcggcaaacggactggacagaaaccaatatgaccgtaacggaaaccccatagacacgacagccgtagtagatgccaacactatccccatcggactgtactcatggaaagtggacagtcgttttggcaatgtcacttatatccccgtagataccttgcagcacgctttccagaactcaaatgacatgggcggctacaccggacaatacaattacttgggaaatttgggttccccccgcctctcacgcatcttttttgaccgtcgggatcccagccaatactttttcaccgacccatacgacttttgcgtacaacgtccggaagatgtcatattcaccaatacattttctccattcacgaacctgagctattacaaaggaggaggcagccgtgacggagaagaacgcttcaaatcctattttgccatcaatgcaaacaaaagactggggtttggattctacatagattacctgtatggccgggggctttaccaagatcagtccacagccttcttcaacggtggcctgttctccagctaccggggagacaaatatgacatgcatttcatattcaacaacgataacttgaagatggcagaaaacggaggtatcacggacgaccggtatatcaccaacccgctggatatggcagaaggcaaaaaagaatattccgccaacgaaatcccaacgcgactgagtcagatatggaatcacaacaccagctaccatgccttcctgacacatcgttacaacttagggttctataaagaaaaacaggacagtgtggatacggactccgtaaaaataacgcaggtatttgttcctgtcacaagcttcatacatacattacaagtggacttgaacaatcgcaaatacatctcatacgatgacgcacagaatcagaagtattttgaacataactatctggggaccgactcaatagacaagacgaagcgcacatccatcaaaaataccattggcattgctttacaagaaggattcaacaaatgggcgaaagccggacttaccgcctttttaagttatgaataccgaaacttcgccttgaccgacacgacaaacataccgggacagcgcattatcaacaactataaggaaagttcactctccattggcggcgaactatccaaaaaacaaggaaaactattacattacaatattctaggagaattggccatagccggtgaagatgcaggacaattcagcgtagaaggcagaggggatctgaatctccgtttattcggagatacggtgagactggatgtaaatgcattcatcaagaaccagaaccccgtattctatttcaggcatttccaatccaaacattactggtgggacaacaacgatttatccaaaataatgagaacccgactggaaggaaaactaagtctgaacagatggggaacccaactgcgtgccggagtggaaaatataaagaactacacttatctggccaatgccagcataccggtaaaagacagtgaaggaaatgtcaccggtttcaagaacaatgcagccgtaagacagcactccggcaatatacaaatattcacagcaatgttgcaacaaaaattgaaagtaggaatatttcatctcgacggtgaagtagcctatcaaaaatcaagtgagcaagacattctgcccttaccggaattgtcggcttacggcaacttgtacatgaaattcggtctcgccaaaaaagtactccagatagaaatgggagcagatgtgcgttatttcagtaaatattacgcgccagactactcccccgtcatcggacaattctataaccagaatcctgatgacaaaatcgagataggagcttttccgatagtcaacgtctatgccaacctgcatttaaaacgtacccgcttctttattatgatgtatcacgtcaatgccggttcgggaaaatccaattacttcctggcgcctcactacccaatcaatccgcgaatgataaagttcggcctttcatggaatttctttgattgacggtctatatgagaaaatatctgaaatacattctgatgggtatccttgcagtaaccctatcctccatcttcttcaaaaagaaaacggaggctgaaaccagtctgccccgcgattatgcagaaatagcggcatcgggaatcctgcgtgccgttaccgagtacaattctatcagtttttatgccgacggcgacaccgtttccggtttccactacgaactgctccatgcttttgcacacagcaaaggactgaaaccggaaatcactcctgaaatgagcttttccaaaagactggaaggcgtacaaaaaggaacatacgatatattggccaacagcacggtagttaccacagaatacaaagactccctgttgtttacccgccccattatactgaacaaacaagtactggtacagcgtaaacccgaaaaagaaaacgatagtctgtacattcacagccagttggaactagcccgcaagacccttcatctagtcaaaaactcacctgccatcctgcgcatacataatttaagtaacgaaataggcgataccatctatatcaaagaagtggagaaatacggacaagaacaattactggccatggtagcacatggtgacatagactatgccgtatgcgacgagagcattgccaaagcctccatcaatgattttccacaattggatatagaaacagccatcagcttctcacaattctattcatggggagtaagcaaacattctccaatattgcttgacagcctgaattcctggttaaatgactacgtcaagactcctgcattcaaactgttgcgcaagaaatattacaataactgatttttatccggctgaaattgcaaaatagtcctatctttgcaatataaattgttattattttaagcggaatgacaaaaaagttattaccatggttaaattagacaaagtaaaatggggcttcatcggttgcggagaagtgaccgagaagaaaagcggaccagcctttgccctgatcgaaggttcagaggtagtggccgtaatgagccgtgacaaagaaaaagctcaatcatacgccaaaagacacaacattccccgctggtactccgatccgcagcagttaataggagatgaagatgtcaatgctatttatatagccactcccccctcttctcatgccacttttgccattatgtccatgaaggcaggaaagcccgtatacatcgagaaacctatggcggccagctatgaagactgtgcacgcatcaaccgcatatcacaggaaacaggaattccttgtttcgtagcttattacagacgctatcttccttatttccaaaaagtacgccagatggtagaggacggagaaataggcaatgtcatcaacatacagatacgtttcgcccagcctccacgcgctttggattacaacagtaccaaccttccctggcgtgtacaacctgatattgccggcggcggttatttctatgatctggctcctcaccagctggatttgctacaagatatgttcggctgcattctcgaagcccaaggatacaagagcaaccgtggcgggttatatccggcagaagatacgataagtgcctgcttcaaatttgattccggtctgccgggatcaggatcatggtgtttcgttgcccatgaatcggccaaggaagaccgtatagaaatcatcggagacaagggaatgatctgtttctctgttttcacttacgatcccatcgccctgcatactgaaagaggccgcgaggagtttcttcccgaaaatccccctcatgtacaacttccgctcataaaagccgtagtagaacacttgcagggaaaagctgtctgtacctgcgacggcatcagtgcgacacccaccaactgggtaatggaccgtatacttgacaaactctgatttctgcctatggacatccgtcaattatgcctgttttgtctgtctttcctttccgccctcggtgtatatgcacaagcggaacagaaggactcgacagtacaggacaacaagggtgttctcattacattgaccgatggaatagcgacaactgtccgtcataccggaagaaaaatcaggaaagtgggaaaagaattcaacgcggtcgataccacctatatctcgcctaacctctacaatctggctttcatgctggaatccagcagttggtacgaatactatcggttaggcagtaaaggaaacaacggcgaacaaagtttgggattctcccccaatgccagtttcaagctgggggtctatttcggatggcgctggatatttctaggatattctttcgatgtaaaagatattttcggcggacacaagaacaaggcaaagaaaaccgaaatggcactgaatctttatagttccaaatttggtgtggatttatattacagaaagacaggaagcgatttcaagatacgttcttccagcggatttgacctgaaaactcccattaaaaatctgaatttcaacggattgcaaagtaaaatcaaaggactgaacgcctattggattttcaattataaaaaattctcttatccggcagcctatagccagtccaccaaccagcgtaaaagcgcgggttccctgatggcgggcttttcttattcccagcacaacatatcttttgattacgaaaagcttcccggtgaagtgagagcccaactgcatgatgccctgcttttcaagaaagtgaaatattctgattacagcatcaacgtgggctatggctataactgggtatttgcaaaaaactgggtttccaatctttcactcttaccggccattgcctataaaaaatcaaaaatagacgatacgcctaacaccgacaatcattggataaaggatatcaattttgacctgataacacgtgccgccgtggtctataataccaacaagtactttgtaggtgcttcactggtgatgcatacatacgattatcggaaaaggaatttctctctcactaatacattcggaaccgttcgtgtatatgcaggattcaacttctggaaaaggaaagaattccgcgataaataaaaaatataccggaagcctataaagttcttccggtatatcacaggttaattatattagactcacaataaattcttagaagcgggcgccgactgtcagcaagagctgatgccgttcattgtccactttagttgccggaagatctatatcgtcaaaagcataaaagtttgatttatacatatcatatttatatgccaaatccgcataaattacactgccacggtatccaagaccaaacgtaaaggtattcttagactccgtattattaaaatcagtacgcgtgctatataaagacaaggcactataagcatcttttgaaaatgcagccgaagaataattataccctgcacggatgctaaactcaggtatgatccgcgtttccattcctatacggaaagtatggacacctttcagataattctcaacgctaggctgatctcccaattcataaccatccacatccttcagcttactggaagaataatcctgatattcatattccgcacctactgccaccgcacccgcaaaagtagtacccgcactgacattaaatttccacggagtagtaagattataatcataggtcaaataatcatattccggagttaccagaaaatcactcaatgtctggatatagggtttttcataagctaaaatatcagaagataaagtggcattatagctttctcttaaatcataccatgtaggcgtgtgaacggcaaatcccaaacggaaaggagaactttctataggacgtacaataacccccaacttcaaatccataccagttccttccagtctataataattatccaatgtataccccccattatccgcacccttatcatcattcaaattttccgtataagaagtataacggtcataattcacatcatagacccccaaggtagctcctaaatagaccctgtcttcaatattgaatgaaacattaaaatcatattgactgatacctccagtttccttactaaagaagttattgttaaaaccattccacccccatggagcatgaatgtttttttcaggatcattaaaccagtcaaccacaccggttctcacccccattactcctaaaacaggtaactggttccaatatttggtataaggattcttcgcatccagtatgtcattaaactcgctttccgtcaatccatatcgttccatttcctgagccagctggaagctttgtgacatattatccaacgcccctcccatagagaaaaggcggttgaagtttttacttttatggtaattgaatccgaaattcacaaaacgcaaagaagtattgttgcctatcttattgctataaacaaatccaatctggtcaaatgaagcgcgcgttttgtcttcattcattgacacgccactaaagttactctttgtcgaagtattattaaaaccaaaagaaacggacacatcattactacgaaaaatgccgatacccgcagggttggaactcatgacagatatatcacctcccaaagctcccatggcaccacccataccaacaaatcgtgctgttccattcaagtcattccccagcaacttttccgcatcataagcattttgtgcgcttgccgttgccattgccagcaacgtacaagcggttactattactttatttttcatacatcaattctattaaatacaacagtctggtttaatctgctacttatctggtacgcgatctgccaccgccacttgaacgggaaacaccgcctccggaactacgggaagccccaccgccactagaaaaactactacgggaagaagaagttccactactacggtaagagttagacgaactattacgggaaggactgctgctacgggaatatgaactgctgcgagagttcgaaacgccactattgttacgataggcgccacggcttgcagcccctgttctctgataagcagatcctgctgcatttcccacacttctccgggtactgcttggtctggtataggaagaaccccttccttctgtcggacgtgaatacgaattacccgggcggactcctgcagcctgacttggtgaaagagttgctcctgtacgggttctgatagcgcttctattaggacgaaccgaatttacaccgtcagatcccgaaaccactcttcctgatgaagatccgttacgtgttgcggtacgatagctattagcactattacggacattttgtctggaatttcctacatacgaattacgactattcctatcataactattcacataattattccggcttgggcgtgaagagccatagctgttggtgtatcttccggcatgtattcccggattacgtctgcttgagccataccatccatgaccgcctccccagtagccgccgccccaaccgtgaccggaataatgcggataataatgatggtggtggtgatgatggtagccccaatagccaccccagtagccgccaccccaataaccgggatagtaccagctattgtagtaccacggcgaactccacccccaactgaatccccagctggcgccatatggataattccaacgccaatcccaccacaagcggttcgtgtaagtgggaaaaacgtatgcatacaatccgtcatcatatacattccaatcccatgaaggcaaaccgtaaaccacatcccaatagagcggactgcttaccggaatggcgtaacggggattgcggaaacggacgatacgcatcgcgtattcataatcgtcttgagagccctcaaaaccattaacccattcccctctctcattcaaaggtttctcctcaatatacaaggtatcattctccatcgagaagttattatctcgtgaagtataacgacgattatactcatccacatcgcgcacttttcctttcacatccttcactaccactgtagaaccgggggctgcgtaaacggtagtcgtgttctgcttctgcggaaccaccactttcacctcttgcttaacctcctctttcttttcagcttttttcttagggatgaaataaaggtcgtcatcaacgctttgtgacattgcccaataaggcaagcacaccatcataagcgaagctaatacaatctttttcatactcatacctgttttatttgttattctatctactttttctagtgcaaagatagccagaggtttcagttcataacaaagaaaatccctattagttggtagggatttccctattttagtaacggacttcaactattttatctatttctgcacacacacggaaaacagaagaacgtccattcacatacgttgatggtaaacaaatctggtggtaaaacaactttttatattaagttgcacccacttatgccctcatgccctcactaaaagtcataacctactcattattaaaccactacacacagtgagggcatgttaaaaagtgagagcattgccctcatgccctcactcctattttcttgcacatctcacttaaatcattcattcacaacataatacccatttatcggcttataaaccggttgtttgggaagtcccacatttttcagctttccttcctcgcacaagcggtgtaaatggcggctggccgtactttgtgtcatactgcaaagaagctggaaacttttccgctgcacaaaatcatgagttgtgaagaactccgtcagcaatgcgtcaatttcctcatcggtcagtttacttgaatgaaacgagaaccgggtacgctgcacctttaccttccccacctcatccatcaataatcggtcggggcggtaaacaatccccttaagccttacctttgtatttttacgtttcgtcttttcggttaccggctcggtgctcaccagattgggacggaaaaagccgatgccgtccagatgcacctgcctgccttccgccaattcctcgcccatggcgtgtgacagcgcatcgagcacggctattacatccgtttccgtcaatgtacaatatttctgtatacgggcacggagctgggccgtgcttactttcccattcagccggagacgcggatgcaacatattctcttccccttgttgctcagaggttttgggattctcgtaccaatcaaatagtattgccatactgttctttttttattgatgaaagttcaatatctattaatcacggatgtgattaagcttaactacctttgtgattaattttaatcacctttatgatcagacttaatcacaagggtagataactaattacaaacatacaaaaataagaaaagaaaaggtagaaaacaaataagagacaggggaatatgcactgagactaagaataaaaacacagaaaagaaaggaaaaagaaaaagacggcatttaatccggaaagcatttgcagaatccggaaagaaaccttatctttactaaaaatatgcacacatagacactcgcaatacgcagtcttctccacacgacagaacatcatcttttccatgggaggtacataaaaccaaaaaacattcaaacgaaagacaaatatgaaaattacactcatcagaaaagatgaagaacaggggacagaagccttgtcactatgcgatacggacgcattcttcgagaaagtaaagacagagaacaaagcagggcatatatcggaactgcgtgaaatactaccccggctggcaggatcgtccgcccgctacgtccacatcgacaaactgccgcgtgtctatcctgccgtagaatatacccgcaaacaaaagggtgagaaacgtatgaaacattacaacggactggtgcagctggaagtgaaccggctcgccgacctgtatgaggtggaatatgtgaaacgccaagtagagcaactgccacaaacctttgccgctttctgcggttcaagcggacggagcgtaaagatatgggtacgcttcgcacgcactgacggcagcttgcccactgccacacaagaagtccttctgtttcatgcccacgcctatcggctggcggtgacatgctaccagcccatgcttcctttcggcatcacactgaaggaaccggacctgatgcaaagctgtcgcatgaccgtggatgaacaaccttactataacccttcgtccgttcctttctgcatagagcaaccgcttgccctgcccgatgaggaaactttccggcaacggaaacaaaacagcgaaagcgcaccggaacgaatgacacccggctgcgaaagtatgcagatttttgcccagatgtaccagtcggcacggaaaagagcattggccgagatggaaaactggaaacgtgatgacgggctggaacctttactgccccatctggtagaacaatgcttcaaaacaggcatccccgaagaggaagccgtacagcgcacgctgatgcactattttcacgcaacggacacagaaaccatccgtacagcttttggcaacggataccgggaaatgaaaggtttcggtaagaaaagcggtttcagtaaagagcaggaagccaccttccggctggaggaattcttgaaaagacggtatgaattccgcttcaacaccgtgctggacgaggtggaataccgtcaacgggactccgttcatttctatttcaagccattagataaacgtacccgcaacagcatcgccctctgcgccttaaaagaagggctgcaagtgtgggaccgggatatagaccgctttctcacctccgatttcgttccgctttacaatcctgtagaagaatacttgtgtgaccttccccgatgggacggtactgaccgcatccgcgcacttgcccggctcgttccttgcggcaatccgcattgggaagaactcttttaccgttggtttctaggcatggtggcgcattggagggggatggaccgccagcatggaaacagcacttcacctttacttgtaggttcgcaaggattccggaaatccacttattgccgtatcttgctgccacccgaactccgtttcggctatgccgacagcctggacttcagcagcaaacaggaagcggagcgtgccttgggacgatttttccttatcaacctggacgaattcgaccagattaccgtaaatcaacaaggctttctgaaacatctgttacaaaaaccgacagccaatctgcgcaagccttacggaaccagcgtgcgcgaattacgccgctatgcctcattcatcggcaccagcaatcagaaggatttgctcaccgaccccacgggaagccgtcgctttatctgtatcgaagtgaccgatcccattgataccaatgtcaccatagactaccgccaactctatgcgcaagccatgcatttactttataagaacgaacgttattggctgaatgacgaagatgaggccgttttacgacaaagcaacagcgaatttgagcaaatatcacctttggagcatttattccattgtaacttttcttctgcaaccaacgaaaaggagggagaatggatgactgccatggatatttttaattatcttcaagagaacacacgcgacaaactgtctatcaataaaataaattggtttggacgtattctccgcaaactgaacattcctaaaaagaccagtaccagaggtaccctatatcatgtaacaaagttgaaataatttattttaccataggaaagtatgagggcaatgccctcatactttcctatgctaccatcacaaataacctgttcattataaacaaattacctcacgaatgagggcatgagggcataattgcatctaactttgcaatgagagcacaagtctgaaacaaaaagacggaaggtttgtttgtgaaagtaatgaaaagaaattatctttgtcatcatccttaaaccaacaatcgtatgaaaccagtgaaattattttatcaggaaagatgcccgttctgcaaaaaagcactgcgctatattgaagaactgaaagcagaatatcctgaattccaacctatagaaatagaaatgatagaagaaacccaacatcctgatatagccgaccaatacgactattattacgttcccacgttctatgtggacggggtgaaagtgcatgaagcgggcatcttcaaaaatgagatggaggcattgctccgtaaagtgatagaataaacgaaaagatatgaaatatttagaagtaacctttacaacacatccctgtaatgaaacagtgaatgatgtagtgtccgcattggccggagaaataggatttgaaagttttgtagaatgtgaagggggaatacaggcctatatccagcaaactctctttgacgaggaagcactgaaagaaatggttgtgaacttccctttacctgacacccggatagaatacaccataaaggaagccgaagacaaaaactggaatgaagaatgggagaaaaacttctttcaacccatcgtcataggtgaccgttgctgcattcacagcacgttccacaaagacactccgaaaactgagtatgaaattctgattaacccgcaaatggctttcggcacagggcatcatgaaacgaccagctctataatcagcgagctgttagaagccgacctgaaaggaaaatcagtcctggatatgggatgcggcacttctattcttgccatccttgcctccatgcgaggagccaatcctgtgacagccatcgacattgacgactggtgcgtcaacaattcaaaagacaacattgcactgaaccatatccataacattacagtggaactgggtgacgccaatctgctgaaagggcgcaaagcgtttgatgtgattattgccaacattaaccggaatattcttctggcagaccttccccattatgccgcctgtatgcatccgggttcggaaatatttatgagtgggttctatatacaggatattccttttatccgcgaaaaagcggagagtctgggaatggagttcgtacatcatcgggaaaagaacaactgggcagctgtgaaattcatcatgaaataataccattttcaagtatggcaaagacgcgataaagacggagttgccaccaaccacgcaggatatgcattgatttattcgaggacaaaagaacggattttctctcttttgtccttgtgttcttcttccctgaaaattagaaccggaatcaagcggtgacaaacgcatgtaggacgctgcattttatccaaaatgaccaaacgaccatacggtattatatttattatacaatctcctttccgaaaggagtaagtgccaagcccgccagcttgaaatgttgcagtccgaatggaatgccgatgacagtgatgcaaagcaacaccccgaatgccagatgagagaggctgatccagattccacctacaagtatccagatgatattcatcaacacactgagacatccaccatcaccgggacaactgcgtatttcccgcccaaaaggacaaagagccagcatagacaacttcaaagtctggaaaccgaaaggaatgccgacgatagtgatcatcagcaacaggctggaaacaatatattccacgcagatcagaaatccgccgcaaatcagccaaataatattgagcagtaagttcataaagcaaatataagcaaagttttcggaacctcaggcacagttcccttatttctttatggtcattaattgcaattcttccaacgaaccgttgaaaatattcaaatccaccttctcacgaatacccggcaacgtacccacatccgtatgctgccagaatttccactcccccctgtattccaccgagtctacataataatgagctatccagtaaggataagaattgaagaccgaatcattcagataacgcgttttaaacttataagaagtataaagaataggcttcactttgtagtgctgttctattttgtcaagccacagtttaaggtcacgacggagctgattctcatcctttcccctcttctcaatatcgagcacaggaggaagatcacctgaatccagcttgacggaattgataaaaaaatcggcctgacggacaggatctgtcttcggattgtaaaaatgataagccccacggataaacccatatgttttcgccgaatcaaaattggagctaaaagccttgtccccataatcgcctccttccgaagctttcataaagacaaaatgaataggaaattttccctgtcgggtctgggtcagcattttccagtctatgtttccttgataatgggaaacatcaatgccatgcacatgaaaacctgagggcatacatacaccgtatgctttaaaaccatagcaaggcttccaacggtaagagtaaggacggataaagaaataaaagaaagcggcaaggaataaaaaagcaataatccccgcaatgacataccgaagccatgacggcatctctctttgcggtttctttttcgccttccgctgtgtggtccggcggacaggtttcgcgactgccttttttttaacaggggcaggacgtgtgcttttcgctcttaccattttatcctatttagctgtttttaccttacctattcccacatactatgcaataaaacccatcgggagaatggttttacaatcagccccgatgggtttcctttatgctttatagaaataagaaaaaattattttccttgttccaactgcaatgtcttggttgcctggtcacaaacttctgtaggaccgaagtactggataggacccggatatacatagtctgtttcaatagcccaacgttcacgctgtgcggcgaacgccttgaaaggagcaccgtccaattttaccaacgctttctggataaccggtttcatttcaccgtgacgacgttccatgttcatcatcattgtgataggcacaccacctgcaatccattcttcggcaggagcagtagtgttacgtacagaagacatataaccggtcttgccgttggcaatcaacatagaagcggtgtaacccaacgagtagcaatagtcagcatcgaagtttgacggagcagcgcaacggccttcgtaaccgaagaagtgatgctgagcggcaaatttacctacatacttgccttcttctttccactgagccaatttaacggctaccatatcagacaacagcttttctgtttcaatcagtgatacctgtacgtttccgtgcgggtcacgatccaaagtaagctgacgtgcaacgccttcgggcagagaagcatagatttccgagttttccttagaaagcttggagatgatatattcacgttggtgagatttcttgatcaatgcgaactctgatgcgttagcagccaggaagtcgttcaattcagcgatcaatctcttcattgcggggatgaattcgatcaaaccttcaggtatcaacactgtaccgaagttattgccttgtgcggcacggttagccaccacctgagcaatgtaagtaaccacatcatccaatgacatgttcttctcttccacttcttctgaaacgatacatacgttaggttgaacctgcaaagcacattccaaagcgatatgagaagccgaacgtcccatcagcttgataaagtgccagtatttgcgggcagagttacagtcacgctgaatgttaccgattacttcagagtaagtcttacaagccgtatcaaaaccgaaagaagtttcaatcatctcgttcttcaagtcaccgtcgatagtcttcggacaaccgataacctgaacaccgcagttcttcgcagcatagtattctgccaatacacaagcgtttgtgtttgagtcatcaccaccgataattaccaatgccttgatgcccaattccttgatgatttccagacctttatcaaactgttctaccttttccagtttggtacgtcccgaaccgatgatatcgaaaccaccggtattgcggtattcgtcgataatatcggaagtcagttccatataattatggtctaccaaaccaccggggcccagaatgaaaccatacagtttgctgtccttgttcaatgctttgataccgtcgaacaaaccggaaataacattgtgtccgccgggagcctgtccaccagacaagatgacacctacgttgatggcaggcatattgacagcttcgccttcaacgaactgaatcaacggcatgccgtaagtgttagggaacaaggctttgatagcttcctggtcagcaactgactgtgtaggttcaccttcctttacttttacagcgcctttcaacgctttaggaagtttgggctgataagcagctctggcaatttgtaatgcacttttagtcatattctattattctatttaaaggtgtataatttcatttataattcacgtgcaaatttcgttcttttttcgcaaatatgaaaacgtatacaaataaaaatattacctttaccgcgaatttagaattatgtattaacttaaaacattacatttatggcaagtagaagaaatttaaagaaaaaaataaccaatatagcaagtgatttgtttttagtcagtttgatggaaggtgttaaccgtgaagtagtttgcaactctgtacacaatgtgatcaaactgattatacgcatcagtcacactgaaccgggtaacgtaaaaggtttctacaagaaactgaatgaggatttgaacaaagaaataaaagtggttgcagacgaactggctaaagctacaaaagcataagatttaaggaatgaaaaaagctatttgtggttttatctactacaaactattgggatggaagactaaagtatccgttcccgattatgacaaatatattatctgtgccgcaccgcataccaccaattgggatttgttcataggcaaactgtttatgggagctataggtcgcgaaaccggttttatgatgaaaaaagactggttcttctggcctctaggccctattttccgctggatgggagggattcccgtagaccgtagccgcaagacttcattggtggaccagatgattaaaattgccaaatcgagtcaaaaattccatctggctatcactccggaaggaacacgcaaagccaatcccaattggaagaaagggttttactatattgcgcaaggggccggtctgcctattattctggtagctatcgactacgagaagaaatgcatcacagccgaaaaggtaatacatcccagcggtgatttggacaaggatatgcgtgaagtcaaattgtattataagaatttcaaaggcaaatatcctgaaaacttcagcatcggaaaagtagaataacccttccgttgtagttcttcagatatgaaaacactgattatgcggattgtattttcacccgcataatcagtgttatttgtatctattctcttgctatactctcatccccatcctcaaaattattcttctctatcttcacattccgggtgtgaagcaagcggaaacgggatttgttatgatgaaaagccggataatccgtattctggcggatcacattgtttttaaagatcaatccgtcaatggattttgcaaaaaggacagggcggtcaaaggtttcaaaatagttatcttcaatcactactcctttttctccttttccaccatggaaatattttttctgatgctccaaatcgggaatctccggataaatagagataacagcttccgtaaactggaacatattagtcaatgcgttgataaaacgattgttacgaatcagcacattccggcaagctcccgtttcaaaccagccgttacaatcaccgcacagcaatatggctgttcctgatgtatgatcaaacaggttacgctctaccaccgttttcaggggagtgctgaacagcgtaccgcgtgcacggttgttacgaatgacattatccgcaaaataaacttccgggcaccaggacaggttttcaatgccgaaaccttctttatccgtaatctccgcatccaaaggctcggcaaaagtgatacgatattcttttgcacctttcaccgtatctttgtcattgggcaggatttccttcacccggttctttccaccggtcagttccatggtggcggaacgtacaaattgtacttcatcgccattcacgccccattcgaatccgtatgcttgcggatgcatgtatcgggcaatcaccgtatggtcatcaaggcgttgcttgattttcaaataagtaccatgtacattaatcgcatcatccatcattccttcatacaacccgttgcgagaatcaatcttcccccggcaactggagaaatgggtagcatccgcctgcgtggtaaagtaacgcggatccttatcgccacgaagacaaacgctgaattcatccaacgtgatattttcacataactgggccagcagtcccataccttcggcataatgcactttcacattctgcaaacgggtgtctttatcattggacaagaatatacccggagcaggacgataataagtacgaagagccaccactgtccccggtttcaaccgggcgtctttccattgaggagcatggtagacacgtggagagatttccttcaatccttccataggacaccataagtcactggtgcggtataccagacgctttgtcttttcttcaaaagcaatccctccctggggagcactggaccagccttcaccgtatgcttcgaaaaaacctttctcattgatacggcatttcacccatgcggcaggttcaaaagtaattccctcctctccgctttccaatatcttgacatgagcaatatgaggagtctcaaaatctatgctgaaattacgcaaagtacaattctctgaacgaagcagagaaagtggaagcatacgtccatgaaagataaaatcggcgccctgtccgtccaccgtcagccccttccaatcctccaaagggaaacctaccgttttcggattgtcctgatcatgattggaaatataatactcacggacagccgccccttcaggatggaaatcgtaacgtccggattcaaaaagcagagtgaccttatcacccaaagcaacttgagacttgatgtcttgtaacgccttctgcaatttgggtgaaagattctcgtgtgtgtccggtaccagaccataatttcgcatttcgactaccttacttccggcaaaagcggaaacagccagccatacgaagcagaaattaaagataattcgtttcatttaggttcattatagattagttagaatgacaaaactaacaaaaattcctaacttcgcaaccataaataaagaagaaaacaacatgaaaaagatatttttgtccttcctgctggtaatggcaggaatatcacacactttggcacaagggttagatggtaatgtggaacaacgtctaaaagattttttcacccggtacgaaacatcttatgccaacataggtaagtgtaaattagaccgttatgaagtaaatcatgacaaaaaaagactgaatgtatatgccagccccagcttcggctaccaaccgtttacccccgaaaagacagaagctatctaccggttacttagacaaagcctacccggtcctgtaaattattacgatataaccatctatgccgatggcaaatcaatcgaagacctgattcccaactatctgagaaagaaacaggacaaaagccgcttatggcaacggacagattataaaggtgatccatgggtaaaaaatatttcccgcccctttactgccggcaaaggactggaaggcagacacatcgccctttggcaaagccacggaaaatattataaaaaggacaagggatgttgggaatggcaacgtccccgcctgttctgtaccacagaagacttgttcacccaatcattcgtcataccttatattatacccatgctggaaaatgcgggagccatagtttatacccctcgtgaacgtgactggcaacgcaatgaggtgattgtggataatgatacccatccccaaggttgcatctatcaggagataaaaagccggaaaggtaaatggaaaaccgcccccaccccggcattcgctcaaaaacgattggtttaccgggacggacaaaatccttttgaagaaggtacagcccgctttgcctccaccgagaaaaaaccggaaaaagcctttgcacaatggattccccatattcccgaaacaggaaaatatgccgtctatgtgacttatcagactttacccggaagtgtgagtgacgctaaatatctggttttccataaagggggtgtcaccgaatttctggtcaaccaacaaatagggggaggaacctgggtttatctgggcacttttgaattcgacaaaggaaccaacgattacggtatggtggtactaagtaatgagagcagacaaaaaggagtggtatgcgccgatgccgtccgttttggcggaggaatgggaaacatatcgcgcggtggaaaaaccagcggcctgccccgttatctggaaggggcacgctatgccgcacaatggtcgggttttccttattcggtttacagtcccagcgaaggtaagaatgactataccgatgatataaacgcccgcagccggataataaactatctcagcggaaattctgtgtacaatccaaaggagaagggattgggcgttccttttgaaatgaccttgggagtgcacagcgatgcaggtttttccaaagaagatgatttaataggcacgctgggtatctataccaccgattataataatggtgaactgaacgccggtatctcccgttatgcttcccgcgacttggcggacatggtactgaccggtctgcaacaggatatctccgcccaattcggtatccggtggcaacgccgcagcctgtggaaccgcaattacagcgagacccgtctgcctgccgttccctcgatgattctggaactcctctcccaccagaacttcgccgatttgaaattggggcacgatccgcgtttcaagtttaccgtaggacgttctgtttacaaatccatactaaaatacctgagtaccatgcatgggacggattacgtagtccaacctttaccggtaaataactttgccattcactccggaagtaggaaaaacaccttccaactaacttggcaagcggtagacgacccgttggaaccgactgccaaagctcaacaatacatagtctatacccgtctgggacatggtggatttgacaatggaacgttagtacgcggtactgaatataccttcgaagccgaaccgggactggtatatagtttcaaagtaaccgcagtcaacaagggcggagaaagttttccttccgaaatcctgtcagcctatcaggcaaagaaaagtaaaggaacaatcttgatagtcaacggattcgaccgtttaagcagacctgctaccgtagaatctcctttcttgcaaggctttgacttgaatacggatccgggaataccttatataaatacacccgccttctgcggaacgcaacaaagcttcgaccgcagccgcataggacgggaaactaaagacgggctgggatatagcggcagcgaactggaaggaatgttgatagccggaaatactttcgattatccgttcattcatggaaaagccatccaggcagccggaggatactcttttgtatcgtgtagtgatgaagccgttgaaaatggttttgtccggctggcagattaccccattacagacctgatattcggagccgacaggcgtcctttctcccacacattgcaacagttgctcacaacctattgtcaaggaggcggcaacctgatgctcagcggctcgtatataggaagcaacatgaacagtcccacagcactgaacttcaccgaaaacatattaaaatatagtttcggaggcagcatgataaattccacttcgggagaaatatatggagccaacacccgtttcagtattccccgcactatcaacgagcaaacatacgccgtacccgctcccgactgtctgaccccgatagcccctgcttactccgcttttgtatataatccgggcagttacagtgccggtgtcgcctataaaggcaaatatcggacttttgtcctgggtttcccctttgaaagcattcagggagtgaaggaaagagcacgggtaatgagtgccatcctgggcttctttggcagcaagtgatatttttaaacgaaaataaaagggcaaataagaggttatttcataaaaacgcctaactttgtccgtataaaccattaaaataaaacgactatgtacactatacagactaatgcctccggcacacgcagcatggaaatctcagaagagaacctgcaaactattgagaaatatgctttattccagcatctgatagacagcaacggtatcgtggacgagtcggtgctggagaaactgaagttgaatatccgttcactgataaccagcgaggaaggaaacaataaagagctgctcgacctttgtatcgatgtaatttatcataataacatgaaagctttcggacttcatcaactcattctgctttatatccaatgggagaaagagaaaaataaagatgaagaagagatataataaacaatctctgtgttctctgtagcaaaacaaaaaaaacagtatttatcattgaaagaatacaaacttacagactggttgccgacaaccaagaaagaagtagagatgcgcggatggaatgaactggacgtaatcttgttcagcggtgacgcctacgtagatcatccttcatttggtccggcagtaattggacgattattagaggcgcaaggtttgaaagtggccattgtgcctcaacccaactggcgtgatgacctgcgcgattttaagaagctgggacgtccacgcctctttttcggtgtgtccgccggatgtatggacagcatggtaaacaaatacactgccaacaagcgtttgcgcagcgaggatgcttatactcccgacggccgccacgacatgcgtcccgaatatcccagcatcgtttatacacagattttaaagaaaatctatcccgacgtacctgtcattctgggaggtatagaggcatctttgcgccgtgtcacccattatgactactggcaggactgcctgcgtaaatcaattctgatagattccggagccgatttattgatctatggaatgggagagaaaccgattacggaactttgcaagagaatgaaagaaggcaaagacagtcaggacggagcccatttacccttacaaaaggatattccccacgatataccacaaacggcttaccttatctgtaagaaaggatcagttccgtccgagcactctgtaattgagtgtgtgaacgaaaagccagatatcatcctacactctcatgaagcatgcctgaaagataaaaagaaacaagccgagaacttccgcttcattgaagaggaaagcaacaagtacgaagcctcccgcatcttgcaagatacaggcaatgaaacagtagtagtcaatccgccttatcctccaatgagccaaggcgaactggatcattcttttgatttgccctatacgcgtatgcctcatcctaaatataaaggaaaacgcattcccgcattcgacatgattaaattctcagtcaatctgcaccgtggttgttttggcggatgcgccttttgtaccatttccgcccatcaagggaaatttattgtaagccgaagtaaagagagtatcttaagagaagtgagagccataactgaaatgcctgatttcaaaggctatctgagtgacttgggaggacctagcgccaacatgtatgccatgcgtggtaaagatgagaaaatttgccggcgatgcaaacggccgtcatgtatccatcccaaagtatgtcccaatttgaacacggaccatcgccccttattggatatctatcattcggtagacgcacttcccggtatcaagaaaagctttatcggaagcggtgtacgctatgacctgttacaatatcaaagtaaagatccggcagtaaaccgcagtacggctgaatatacccgcgaactgatagcccatcatgtcagcgggcgcttgaaagtggctccggaacataccagcgaccaagtgctgcaaatcatgaggaaaccttcgttttcacaattttatgacttcaaaaagactttcgacaaaataaataaggagttgaatatgcggcagcagattataccttattttataagcagccatcccggatgtacggaagaagatatggcagaactggcagtgatcaccaagaaattggatttccatttggaacaagtacaggactttactcctactccgatgactgtagccactgaaacctggtacacaggttatcatccatatacgttgcaaccggtattttccgctaaaacaccaaaagaaaaactggctcaacggatgttctttttctggtataaacccgaagaacgacgtgctatcatcaatgaattgcgcaaaataggacgcgctgatctgatagataagctgtatggtaaatacaaagcctgagttttaaattcaccacagattatacagatttgatctgtggtgaaactgttttttaacgtcttgtttacctttcatcgtgttttgacgaaacacaggaacaggtacatgtgttccaagttacagatatttattcccccctaaacttaattagaaaagcaccgcaaatattaattgataaaaatacgacctatcctattgaatatcatttattttttgctatctttgggcaaaaccaacttttaaatcaatactgcgtatggaaacgtatctattctggattgtgcccattgcctccctcttggcattggtacttgcatggtatttctacaaacaaatgatgcttgaaagcgaaggaactccgacgatggagaaaatcgcttcttatgtgcgccagggcgccatgtcctatctgaaacaacaatacaaggtggtagggctggtatttctgggattagttattctgttttctatcatggcatacggcttcaacttacaaaatccgtgggtgcccattgcttttcttaccggcggtttcttctccggattgtccggctttttgggaatgaaaacggctacatacgcttctgcacgtaccgccaatgccgcccaacactccttgaacaaaggactgcgtgtagctttccgtagcggagctgttatggggttggtcgttgtcggcttgggactactcgatatttctttctggtacatattattggactattgcattcccacagatgccttgaacccttctgctaaattatgtgtcatcacaaccaccatgcttacctttggtatgggagccagcacacaagcacttttcgcccgtgtaggaggtggaatctataccaaggcagccgatgtaggtgccgacctggtaggtaaagtggaagccggcattccggaagatgatccccgcaaccccgcaaccattgccgataatgtgggagacaatgtaggtgacgtagccggaatgggcgccgatctgtacgaatcctattgcggctctattctggctaccgccgctttaggtgctgccgcttttattggctcggatgataccgtgatgcagtttaaagcggttatcgcacctatgctgattgcggcagtgggtatcgttctctctatcatcggtatttttgccgtccgtactaaagaaaatgcaggaatgaaggaattactcggatcattggccacaggaaccaatttaagttcggtactgattgtcgttgccactttccttatcctttgggcattaggtttggaaaattgggtaaacatttcctttgctgtggtagtgggattaatagtaggtatcgttatcggccgttccaccgaatattatacttctcaatcgtataaacccacacaacggttggccgaaagtggaaagaccggtccggccaccgttatcatttccggtatcggactaggtatggtttccaccaccatccctgtactggcagtagtaaccggtatcatcttgtcctactggctcgcttcaggatttgattttgccaatatttccatgggattgtatggcatcggtatcgctgccgtaggtatgctttcgacattaggaatcaccttggctaccgatgcttacggaccgattgcagacaatgccggcggtaacgctgaaatgagcggactgggcaaagaagtacgcaaacgtactgacgccctcgactcgttaggtaacacgactgccgctacaggcaaaggttttgccatcggctccgcagctctgaccggcctggccctgctggcatcctatgtagaagaaatccgtatcggattaacccggttggggcaaaccattctggaattaccaaacggcattaccgtaaatgttcataacgccagtttcactgactatatgctttattacgatgtaaccctgatgaaccccaaagtgctaagcggcatgtttttgggcagtatgatggcattcctgttctgcggtctgaccatgaacgccgtaggccgagcagccgctcacatggtagaggaggtgcgtcgccagttccgtgaaataaaagggattctgacaggagaggcagaacccgactatgcccgttgcgtacaaatatccaccaaaggagcacaacgtgaaatggtattcccctctctactggctatcattgcccctatcgctaccggactgatttttggtgttcccggtgttatcggtctgctgataggtggtttgtcctcgggcttcgttcttgccatttttatggccaatgcgggaggcgcatgggataatgcgaaaaaatttatagaagaaggtaatttcggaggtaaaggaagcgaagtacacaaagcaacggttaccggtgacacagtaggtgacccgtttaaagatacatccggacccagtttgaacattctgattaaactgatgagtatggtcgccattgtaatggccggactgacagttgcttggagtttgttctgatagaaaaacggaaagccgcttcggaggaggcggctttctaattttaaaaaagattctgataaactatttttaaaacttccccaacacttccatcattgccggacgacgtttgtattttatccggaactctgccaccaagcttttcacaacagcctgtccaccgtttagtttacgtatgcaggataatacccgtgctataaattcataatgctcccgtcccagattccgttcagcataatcattcaataaagaagtatatatagcaatcaatttctcagaatgagtgtccttcaaataatgggcatatttcatcaatgcttccaactgattgtatcggactgacgacagcaaagagaacaagctgtcattatccttttctttcacataaatttcagccttatcatttccgacaaaagaaaaatagtcacttaactcggcttctttcatcatcctatccagaaaacttttccattgttctttcggtaccagagttttaagtttgctgtaatatatcaatttatcactacccaccacaaacaacagacgacatgtatcaattacctcagaaaccctatgggttatttcataaatatccaatttcattttcagccattcacccagagtgccagaatgcatttctctttccgctatttctattccgtcattcagcaaacaaatggcttcatcatattggcaacgggcaatcaatttatcaacctccattcttcgtatttcagtcagataaagatattgacgaatcgtatcatccgccttttgttcttcattctgttctaacaacagattgaccttacgaatgactaactgatagatatcacaggttccctttcttacttcaagaagttcatcaatcaattccaacgctttttctgccggttgaatcgaaagattgatctgcatcatcaattcgtctacatcataaagatcatattcacgaaaaatagatatttcagcaatctcacgcaagccctgaagtatctccatcttttgtgcctgagtggttttaggatgttcaatcactttcaggagcaaatctcctgcctgttcacaatagtcagaagaagaaataccatcatcatacaaaagttcatcatcatagttttcaccgatggaacgaagtacttgaagagctatggcaatagaattatccatagcttccaaattcaaaaagaaatccgctttctccaaaaaagtgtccatctgattgaaaatagttttccagtcacggtcgtaattatcataacgattgtgataacgagaccttttatggtaaccagatcctttaaaaactttttgaatttcaattctgtaatcttttccctttgatgacaaagataactccttagctatgaaatgatttgaaagtgccgttttaaattccagattcgttgaagcatactcacagataaatttcgagagttcctgcggatcaatgaaagacaacagttgctgtatgtctaccaaagacggacaaggctgcttacccacttcttttatttcctctaaaacaggggcttcctccgctttgattttcatcttcgagaaaatactattacccgccttttttctattgtcgcgaattgccaacaatgtcgctacaacatgtttgcagatttctccatcatacggacaatcacagtaccaggattctatctcgtttccatccatagatatctccacattataatcgtctgttccttctacagtcgcagtccattcaccgggtgagatttcttccaattcggaaacagcgtctgtttcataatactcttccccacgcatccatattttatagggaacaaagtcctcaaaattatccaatgtaatcatgtacaatacttcggtattttttatcggttcgagtgtcccattgtcaaagaacgctcataacattctgcattctccaacaaacaggttttgctattgatagactgttccatcaaaacagccacagattacccggattcgcacaggttcaatcttaaagttttcagcttaaacacccgtgtgagcccaagtaacctgtggtaaaaagacttgtgatgcattcatacccacaaagtcaaattcattacagactgttcttagtcaaaacattacaattgaatttattcaatatctccacacatctctccacattagacggacggataaccacatgtgccgtatctccttgagcaaaagcatacatatattcaataaagatattctctgctgccagatagtccaaaactttagccaaagaacctgccacattcgggcaactgatacataccacatcggtcagcatcacggcaaaattctcggcacgaagtacttccaccgctttttccacatccgaaacaatcaggcgaagtataccgaaatcagtagattccgccatgctgaacgcatgcatattgatatcatactttgccaatgtcttggttacgtcatttattcttccggttttgttttccagaaaaacagataattgcttgattgtcatatcgcatacttttttattttaaaatccgattgtctatcacacgtttactcttaccttcactacgggcaatgctattaggttccatcagcttcacttcggcactgatggaaaggacacttttcagtttgtcgctcaacgctttcttcatggcaagcatacttcccatatcatccgagaagaagtctttgcggacttccacttgtacttgcaaagagtcgagattattcttcctatccaccaccagcatatactgaggttcaaactgaggcatatccaaaataacactttccacctgagaagggaaaacattgatgccacggataataagcatatcgtcactacggcctacaatacccgacatacggatattggttcttccacacggacattcaccctccatcagggaagtcaagtccttcgtacgataacgcaataacggcatcccctcctttgtcaaggtagtaaacaccaattctcccacttctccatccggaagacgttccagcgtttcaggattaatgatttcaggataaaaatgatcctcattgatatgcgaaccatgttgctcctgacattcgtaggaaacaccgggtcccataatctcacttaatccataaatattataccctttcaatcccagccgctcttctatctccttacgcatactttccgtccatggctcggctccgaaagctccgatacggagattgatatcattcttggtcaatcccatacgttccaccacttctgccagataaagagcgtatgaaggagtacaggcaatccccgttatacccaagtcgcgaatcagacggacatgcttttccgtatttcctgtagaagccgggataacagtcgcccccagattctccaccccataatgtgcgcccaacccgcctgtaaacaagccatagccataactgacagaaaaggtatcattacgggtaaccccgtatgctgaaagacaacgtgacatcacttcggaccatacagacaagtcacgacgcgtatatcccacaatggtaggattcccggttgtccccgaagaagcgtgcacacgtacaatttccgaagcaggagcagcctgaagaccgtatggataattatcacgtaaatcctgcttggtagtaaaaggaagttttacgatatcttcgatagtctggatatcatccggagacaaatccatctcctgcatcttgttacgataaaaaggaacattatgataaaccaagttcaccaacttgttcagacgttttccctgcagagcgctcatctcgtcccgactcatgcactctttatttttattccaaatcataataaataatttttcaatgtgctaatcagccaatgtactggcgcacaaacccaccgtatggcaatcggcacattatcctattagcacattattttcaatgatcttcatgaaaagctctcatgcgttcctccatcaccggataaagttcatcgcgcatccgtgacgtacaggcgcggacaccttcctgctcgctaccggtagtagaaagcgagatgctgcttaccccataatacaataactcccggagcaattcaccccctgtcatatttccgtaacctatggtaaagaagaaaccatctcccaccacctgggtagcatcataatcatatacgatatggaaaccattgtcggtaaatattttcttcatgcgttccgcacgacgggcatattcgcgggtatcttccacaaaattgattttaccttcggtagacagacggagcatttcagcgtatgcatactgagtggaagccgtacatcccgaagtaatcatataaagaatggaagcaatcagcgtaggaccgaacacccctgcatctttataccgttctgccaaggcagggaactggcggtcgaacagtttgtcgctgatacatgccaatgccatacgctgtccggcataactgaatatcttggaagaagaaagcatcagaatataattatccgtatatcttgccacagtgggcggataaggcggttcgaaaggatgccccatatcccgacggaagtccatgcagaaataagccagatcttccatgacaatcacatcataccgagttgccagttcaccgattatctgcaattcctcctcttccagacaaatccatgccggattattcggattagaatagataatcgctgctatatcgcctttactcaggaaactttccaatttctcacgcaaggcctgtccccgataatgatagatatcaaactcttcccactccacgccgataatgcgaagctgggatttctgaataggaaatccgggatcaatgaacaataccttgtctttccccggaatacgctgcgtacaggctatgaacgagccgaatgaacccgccaccgacccggtggtaggcacacaagcgcgcggagagatatccagattcaagaaagcttttacaaaacgggaagcctcctttttcaactcgggcactcctgcggcagccggatattgcgatccgactcccctgtccaaagcagctttctccgcttcaatccctatctgattggcggcaagaccgggagatccctgatccatgcggataaaaggaatccccgtttccttttccagatactgggctaccaacagcacatcaccgatagtagcctgtgcaagattggcgatgtgcagttccttcaccgccttctccactaattcttcactaaatatcttcatggcattaccagttctttaccgcattcaagcctatatcaaaagccttctgattcatttcaacaatcttctcaccttttgcggcaaacacacgccctatgctttcgcgcaactgttccggtgatacgatttcaatatacttcgcagccatgcccagcagaatcacattcgcgcatttaggcatactgttttcttttgccatatcctctatttccaacttcaccacatgcggaagactctccaaagccctcatcagatccacttcttcaggatagtcgggaatgttcttgaaaggattagcggaagtaatcacccaaccttcttcctgcaagtaaggcagataacgcaacgcctccatcggttccatggaaataatcagatccgcctcaccctgagcgatcagatccgaataaatcgtttcgtcggacaaacgcagattggactgtacatctcctccgcgttggctcataccgtgtacctcggcctgcttcaaattgatgccttctgccgtagcagcttctcctataatagtagcgatagtcaggataccctgtcctcctacgcccgaaagtatgatatcttttctcatgccttatctgcttttttctgtcttagtttacgattcaatgtctggatacactctctgcgcggaataatgacagacacccctttatattctatttcctcacgaatggtacgggtgatttcttccatattcttcggcaacgggaccaccacacgcacatgttcgggttccactcctaatcccaggcagatcgcttcgaatttgttcgtaccggcagaatcctgtccgccggtcatggcggtagtcaggttatccgaaatcaccaccgtgatattggcatggtcattcaccgcatccagcagaccggtcataccggaatgagtgaaggtagagtcaccgataacagcaatggccggaaatacccctgcatcggaagcacctttggccatggttatggaagcacccatatccacacaactgtcgatagcacggaacgggggcaacgcacctaatgtatagcaaccgatatcaccgaaaatgcgtgcatccggatattccgcagccaccttgttcaatgcatcatacacatcccgatgaccacatccctgacacaatgcaggcggacgcggcatcaccacctgagacttgccaaacggacgtttgattccccatccgatcgcctcgcccacattatccggagtcaattcaccggtacgcggcaaagtttccgtcaagcgtccctttacctcatagtccgaggaaagtatcgcttttacctgctcttccacaaacggctggccatcttccactaccagaacatatccgcaacggtctgccatcgtcctgatttcttcagccggcaacggatactgcgaaactttcaataccggaatatggcaactgtccgtatccgcctccttcacataattataaccgataccacaggctatcactccgaattcataatcatattcgggattcaacccttccagataattataaggagatttggaggaaacttcttccagcttctcctgctttttcactaaatccagatattgtttacgcgcattacccggcagcaatacccagtgggcacgttcatgatcaggattcaactgattttcctcacggatatcggctacttccacaccggcacgcgaatgtgccagacgggtaaccacacgcatcagcaccggcaacttcagtttttccgagagtgtatatgcgtaatccatcatatcgtatgcttcttgttgggaagacggttccagcatgggaatcatagcaaattttccataaaaacgtgaatcctgctcgttctgtgacgagtgcatggaagggtcatcggcagccagcaccaccagaccaccgttcacgccggttatggcagaattgacaaacgcatcggcagccacgttcatgcctacatgtttcatacataccaaagcacgttttcctgcgtatgacatacccaatgcagcctccatggccgttttttcattggtacaccaagtgctgtgcaattttctttcctttgccaaaggattattctggataaactctgtgatttcagtggacggtgtacccggataggcatatacacccgatatgccggcatgtatcgctccgagggcaattgcctcatcgcccaacaataatttcttttcagccattatctattattttgttaattgtttcatatcaatgtaaaggggtctgcatcatccaataccgggaatttcttcctgaaagcctgcaatgcctccatatcgatatcagccgataccgcactttccctgctccacggacattcggctatcgtttttccgtagggatcgatgatggcgctgccacccgaatattcacaggcaggatcagttcccatgcggttcactccggccacatagcactggttctcaatagcccgcgcccgaagcagcgcgctccaggcatccacacggggagtgggccagcttgccacataaagtatcatgtcgtaatcccccaggttgcgtgaccaaacagggaaacggaggtcataacatacttccaaaagaatacgtaccccacggaagttcaccaccacacgctctgtgccggcagtgaaacgcttgtgttcgcccccaaaggtgaacaaatgtttcttatcataatgctgcacggctccatccggatggacaaagtaaaaacgattataatagtttccattctcacatactgctacactgcctgcaatagcacaattccgctcggctgccttacgcttcatccagtgcagggtttcactgtcggcgctctccgcaattccttcgggttgcgtacaaaaaccggtggaaaacatttcgggtaaaacaaacagatcagcatccggcagacagcttatcgcttcgtccgcccttgctatattggcctgtggattggcccattctatatttctctgtagaattgttattttcattgtttttcatattataagatccacaaaggtaacaaatataataagatagcaagcattttattactaactatttcctttcactcccttttttcttacatgttttcataaatatcccctatttattcctcataaaaaaagcagcccagcaaggacaagccttgctgggctgcactaaatgccttatttttgtctcaaacagtaacggttatatgaaaccaatctgttgtattcaaagttttatcgttttcaccttacccggaataaccgtcagccgcaccgtcccatccccctctatctccactttctggtatctggcctccaccaccaccttaccatccggtgccatcagtccccattgacaagcattctcctcgaatacacaataaccgccgacgggaggacagatgttcctataacaaggaggaaccacgatacgctcacccgacttcagcccccatttcagccccatccggaaaggacggacatcgcctatctcctccagtctcttccgccttttctcctcctcattccgtttcagcaacaggttcatttcctccgcacgccgcccggcctcctccttcaatctcttcaccgcagagttaaaatcctcctcaccaacctcaggattattacaggcgatatatcgtttcctctttcctttctccacatgataataactcccttgcccgtccatcaccacgatgctccggtctgccagacgaccacagcaccaatacacctcctcgtcatccccttccagcagacaagcgaaaacatcgaacacggtagaccatacaggatccgccaacttgcaggacttcgggacacgatagtccggtatcttcagataaaagccataaaaacagagactgtccttatgcagcccgcgcatggaagcatacgccttccgtgtgcggctatgaaaggtctctcccactttcagcaattccacgctaccgtaagagcacaccaccggcttctcccgataagtcctgtccgttttcaagtcgatgtaagcatccgtaccatcattgcccgtaacggccagaagctcccctttcaggaatcgcaacctccggcagcggtctatgatgatcttcggctttccgttatcgtccaccacccctgtacggccatcttccaaacaaaccgccgcccggtccgcacaggtgtcgaacacttccttatatcgaggcatcactgtcactctgtttctacgcctcagtccccacaatccgctacatcggtcatggaaagctttcagaacagagagtgcattccgcccctcttcctgatcagacaaattccggttcctgatcgcatccagcaactgtccatgggtcatcaccatttcccattcttcctcccgcctgccttcctccaagagcgaacacgtcacggacagcccgttttccgctcttttccgagaaaaggtgtcacccagtatccgcccctcgaacatcgcttcccaatcccgctcacggacgggcagaccgaatatccggtgcaaccccacattatctatcagcatacaggattccttatcacccgatttccgtaatcccctccccacctgttgcaagtatttcgccagtgaaagcgtgggacgagccagctgcacgaactccacatcgggacagtcgaagccctcggaaaagatatccacattgaccagcaccctgatccttccctgcctgaagccctctaccagttccctacgctccgaagcaggcgttttgctgtcgatagccacagccgacactccgtgtgcattgtaataggcggctatctgacgggcatgggctatactgacggcatacaccattccttttttcccggcggcatacctctcgacgctctcgtacaaccgccggatgctgacctgacggttcaatacctcattcatttccttcacctgataatctccgtccaccccacgtttcttcaacgaatttattatctgttgctccctgctgtcagcacggatagacacgtagtcgaaagcagacagccagcctttcccgatgaattccgcgatgctccacgaagttgtcagcgcatcaaacaaatccgtgaagcccttgccgttcagccggcagggggtggcggtcatgcccagtttcctcgcctccggatatctcttccaaagctccctgtaagtctccgccagtgcatgatgcgcctcgtcaatgacaatcaatccgggagcttcccctatattcttccagttacgggacaaccactggatggagaatacccgcacccttccggattcttccggcatactgtctttccccgtctttccgttctttcccgttttgtccggttcttttcccattccataccgggctgcggtttcctctatctgctccaccagctctctgcgatgcgccacaatccacacccgcgtgccgataccgataccacagagaaactctttcaccaccgctgccagcagatgtgtctttcctgtgcctgtaggcatttgtaccatgacactccgatggaactcccactccttaaagagcctgagcttcatctcctgctggtagtcacgaagaccatcgttcttgcaatacatcatggtgcggatgccggtcgccaccgacaacaaaagagggaaaggctgcatgcatcatcgcacacagcctatagtgaatattctatctttatgaattcatttttatcagcagcttgctagttgatatcgtaaatatttgatatcgcaaaccgttccgccactgaatttaatacgaaaccgatgacaggggctatttttctatgagccagtcgcccaacgtatgctcctccgcatcaaagctgatgcccactttcaccacaggcagtccgctgagggtaaaacgttcgggatagtttttcaaatttatctgagacatggcggcatcggcatccttgcctagtttcaattcaataacatacaacatgtcggcagtgcgcatcaccacgtccacacgtcccttcggggtacggacttccacatccacatacattccgaaaagagagaagatgatgtagaacaactgctggtaatgcccttcataattcgtgttatcgcaataaggaacggtggagagaaactcctgaagcagacgcaaggctccatccatatcgcccaagcgtatcgcaccatacatacggcctatggtagtaagccccatatcggtattgtaagccagatagttcggcaacagactctgcatcagtcccacccgtatctccctgttcggaatatccagcgtgtaaagctcggtatatttatcatagtcctttatcgtgacatagccgctctgatagagcaaaggcgtaatagttgtcatccgctcggtaggggcatcaaaactggcagccatagcctgcatgctgtgtcccacttcagagggaagaacatggaacttgcgcagcatctctatcagataggtgggcgtgccgctgccaaaccaataagagtttaacttgccatcttcgaaagcattcagcaggctgaacggattaaaaacatctggcgaaggccaggtgaaatgatagccgtcatatttctcttgcagtttcagtagggtatcttctttgctcatctcctgcgaaagggcaaagcgttctatatacccgcccatctgttccaacatttcctctttagtgataccgcaaatggcagcgtagggctcgtccatgctaatattcttgatattgttcagctcgctgaaaatgctgagctgggaaaacttggtgatgccggttaggaacacaaagcgcagataagggtcgcacgccttcaacggactgtagaaattatgcatcacattacgcaggacggggaggttctcatcctcgtgcaccacatccagcaacggcgcgtcgtattcgtcaataaggactaccacctgccggccggtctgctcgcaggcacgctttatcaggtctgccaactggacgttaacccccgcatcattgtttttcgtcaggccatatttctcattatattcccgcaaccgccaggccagatactcattcagtttctccttgtccagatgcttggccaagctcatgtcaaagtgcagcaccgggtattccgtccactcggtttccagcttttcgatggcaagccctttgaaaaggtctttcttcccggcaaaatagcagtgcagcgtagaggtaagcaatgacttgccgaaacgccgggggcggctcaggaaacaatatttggaggcaccgttcgccatccggtaaatatactccgtcttgtctatataaagataattcccctctatgactttctcaaaagcctgtatccctatcgggcatctcttcaatgactgttgcttcatggcgcgctactttttctgattgtactacaaaggaacaaaatctaaccggaaattcctaaccgaatgctcttttttattatttcagatggactttaaagacaagacctccggagaagtatttcccattattcagctcggctacaagatttacatagtctttccaaaaactatactcaaaacctatattgcaagttcttgcatcatactccgccatcaggttcaagccatttatcatttttacagcccaagactcttgcacaggcaatcccaaccggaaattcacccctatagccggacggttatgatgctcccaggtagccggccggtccagcacccaggcaagatgcactcccaacattcccagattatcaaccccaatatgcttcgtagcagcaatatagtaacgggtgaaaaagcaattaccgccattctggtcacgacttgatatgcctcctccaccgtaactgtcatgagtacccggatcgtccacccctatcacgatctgcggagtccacgttttccaccatccctctttccagacacgaagacggaaattgaaagacctgtcctgattggtgtatttcccccacgactgctccgggaaatatgtagaacccttattggcgtaattcaacgtacaggtatatcccacttccagccagggaaaaaccgtaatattgagataataattgaaggtgtatctcacatcaaaatcataataatgcaacggggttatgtccagcacattacctccaagcataaacgttttgtcctgctgcatatcggccgtcggcgcatgaagcagtccggtcgtacctctcaacgcctgtccacagacggaaaaactgattgacagaaataccaagacagccgtaagtaccctgtataatctcttcttatttgatataaatcccatcttttttcagcgtttctgtgccaacagccattcaaagtacttttcatgctcatccaccaaatgttcccacgaatacgctgtacggatctcctctaaatttgccgcgataaatttttccttatcacgcactacatatacagccatatcattcaacagcccggttacttccgccggagtactataatactccgcatgatgcttcaataccgcccggttgaacagattgtcattggctaatatgaaacaaccggacgccatagcttccagtaatgaagggttcgttccgcctaccgaatgcccatgaaaataggccaaagagtattttcgtatggagttcagctttttgaaatcataaatgccaccgatgaaacgtaccgaccgctctttaccataccgggccaccagctctttgccatgaggagtattggtttttcccacaatgaccaatggcctgcgcccgttctcttcggatgccagatagccgtcaattgccattgctatattgttttcgggttccagacgagccaccagcaaataataaccattctcctccagtccgaattctttcagaaactccggattgtaatcctcgtggatatcagccccatacgccagaaacttgctctccttgccatacttctctttgtaatagtcatgaatgcccatgttgtcggctatcaagtaatgactgtgcttcacagtcatccgttcttcccaaaagacgaacttccgcacccatctgttgaatttcgtacgcttgtattccagtccgtccatgttcgtggtaaacacgggatgtctgatgttctttacattaaaccaaatgtatgccggtacaatggaggtgtatcccgcctcataaatgatgtcaaaccgctcccgtttcaacgcatcacgcagtgaagcaaaatcatagaagaaactccctacggaacttcccatccatgtctccggactatagatgtgcttgatgcggactcctttgtaactgttttccttataaggatgaaaatgaggggaataaacggtcacctcatgacctctgtttgccagacctacagatatgtattcggcaaactgctcgaagcccccgtaatcattaggaatgccacgggtgctgataaaagcgattctcattgaaaattaagtgtatgaagtttagcccggccgcagaaagcgaccgggaatattaaaaaaaataaaacattcggttttttgtgggaatgcggctgtttcagcccctcaatcctgtttcaagttcgtgtttcaaaggtgaacacacatattgggaactttggctatagaaacctggtctttgttaaatctcagatatcaaccaacaaatcagtcaagaattcatccaagcctaccactcttattttgggaaaagggaaagtggccagtatacgaaaatgagcatcttcagatactatgtactctgcatttgcaacaatagcacaatctgcaaatttattatcatccggatccgcctctatcaaattgaatttaaaagaagcctctttataaagcgtataaggactatgcactatagcacttataacattccgagctacactggccgaagaataccgttctataatctcttcgtattcattcagtatttcattagatacgcacagcataaacttcccttgcagaaaatcttcccatatcttatggtacgggctttttgcaggaagcgactgcaccaaacaattcgtgtccagaaccaccaatcgtttcatgaccgataaggagttctgagatgttgttctctcaattcatccaattttttctgatccaacacaccggagtcccacaattcgtccagttccttttgtgccttatcagcaaagaaatgagaaagagccagtttcagctcattcagttcactttctgtacgaatattctttatagcataaagcaactccatctgggctgcatccgaatacgagatcctcataccttaatacatttaatcgtttttacaaaaataatacttttctaattatccgcatcacattatgccattcttttccgattaaaatgaagatttaacttttcagaaaagtttccttttaatcattctaaaaggaacaaacatgacattcatccatgctgtccaataggcatgtttagggaaataccgcttgatgttctctctgtatccggtcgcatcaaaagtttcaatgcgcacaatgtatttattaaaaagcaaagtaggaagatattgagtacagatatctttcaaaatcgaatccttacaattcaatgagatatgacctttcatataactgcccacaatcaatgacggataatctatggtaaaagccttgaacttgttatgcccgcctctttttgcaatgcgttgtacatgatatatgggagtatcgtctatcagaaaaaccttggcagcatattgcgttaagaaaacagaagtatgcggaaacaacgcgttcaattctattttccccattgcatcaaagtcttctttccaaatactaaaccctccactccatgaagaccaatacgatagcgcattcataaaatcattgaaatttccgtatttacaaatagctttcttgcctaaaaatccattcgtatggaacatcaaagttttattcatcttttcttgtagtacttcttcaatcaaatgtttcagtgctcctttctgaaacaggttctggctattatgaagtttcaatagtttgcccttagcataggttaacacatgatatgaattgagaaacccttcacaatcagcatgataataaaacaaatttattttatccgaaaattcatccatcaatgtttttacttccatttcaggatcgttatctgaaagaatgacttcatagtcatccatagatatctctgagttcgcttcataaatactgttcaacgtatttcgaacttgatttatgcgtttataacaaggaatacagatagaaagaacaggcttaaatttattcatacaatatctatatttcaaaaagagaaattaagcactcttttatcaccacaaattatattttacacaaaaacatttctaaattcttatgacttcgtattcaataccacctatcatagcccctctcatagcaaatccaccattatacatttccttagacacaacattatatgctttttgggcttttgatattaaaaacaaatcaagaaaagtttttaaggcagcatctgttccactatcataatccatatgtgcaatatcaccaggaattatataaacataagaaaaacatcttacttcattaataaaacgagcactatcagaagttatcaatattttcttatgaaatggagctatttcatgtatataggaacaagcatcaaggcacttcttgatcaatattgaagcatctttttcctttaatattttagatggtgagtctttaaaatcgcctaatgcttgttgaaatctataagaaatagaaatataatcccctcctaaattcttcaaattttcgtctatcaaggattgcaatttaaaagacggtttaaaaagctcagcaaacagatcgtgaaattcactttctgcaaagcaagcatttgtgtaaatatgatattgcattttatgtttcttgacttttgcagccattctcttttcttgaattttccacattcgttcagataatcctgttgagcgtactactggagacgattttcttctatcatatacaatttcctctggtgaaatataccaatcatacatattaggaactaaataatcattcaattcaaaaggatggacaaaatttattttaaatacaagccccatctttttacataatttataaacagaaacagctcctcgtaatctatcagaaataccaccatgtctcatttttccatcggccatgtaaatcaacattttagaagtgactaattgtttggaaactttataacttctcacaaatttattggacagatataaatttacgaacgatgccaatatcgaattccatctattcccgaataaaaaaacgcctaatttaacaataaattctaccattttagttatctgaagtttaacagtttacaagccaatacaatgtcaatataccaaatatattgaattttatttctaaacaaaagtttagaattagacattacattccataactttatgtccgcatacacatttttacataaatcataacatacaaaagcatcatcatccctcaatttacttaaaagttttacagtatatataaaagcatttactttaaacgcctctataaaacattgataatcgatacattcacatctaaccatagagagaactgcatttgtattattaataaaatctttaataattttcttatttgtcgaaacaacaatgctattctgtctcatcctatatttgtaatatggagagttcattatataagcctgttgatacgcttgcactactttaaatgccatttctatatcctcataataatccccctcccggaaacgtaatgaatgagagatccatatttcccttttatacaacttattacaacactgacatcccatacgtccagaaagttgcaacttgtataaaaggtctgcatcataaatagattctttatctgaaatacattttttatacaacttctttttattgtccgaccaatactgcaatatgccacatattattaaaggacaatgcgtttcttttgctttaacatacattttttccaatgtatccaaatctataaaatcatcactatccacaaaaaacaaatattcacctacagccatatcaattcctgcatttctagcagaactaagtcctccattcttcttatttataagctttatattggaatacttttgttgaaacgacttgataatcgaaaggctattatccgtagagccatcattgacaactataatctcaatcccttttagtgtttggcgacatatactttccaaacaatcggataaatattgttccacattatacacaggaacaatcacactgactttataatctgaatttaccggcataactatataaattgaaaaggagcattttttgcaccacgaaaaatggcattaaagaaccacattaaagatatgacaacaagaaataattttaaacacttatcccatgagtattttctcccttgacaagaggaaagcatatacattaaaaatgaaagcattataaatttcacattgacaaaatacatattcacacgaattagcgccaatgaacttccacttataaaatacaaaacagaaccaatcacgtgaagattgtaaaaaacatccaaattaagacttttataaaatgctttcatcctgttaatattagcaactatcaacaaatccaaaccaagcattataaatttagccaaaccaaggctagaagtatctttgggcaaagtcaaatcatcccgctgttcaaaataagaaatatcatccaaagcagacaacaattcgcccaatcgaggaaaaagtacattccataacaaataatttattggtccggacaatgcaaatgacaacaaaatcaaaacagccgaaattttcttattactaaacatccttaaatgcaacacaaagtaaaaaggaagcataatcaatatgctgcgatgaaaaagacttatgcaaactattgaaaggaagaaaggaaaaaaacgcctctgttctacaaacctcaaagtacataaaaacatgaagaaagccgtcatttgcctcataccatttaatgaatcgaaaaatgtaaacgaagtgacaaaaaagaaacatagccacatagacatgaagctatacctcttagaaaatatatacaaaaataaaatctgcaaaaaagcgatactaataaacaaccatgcaaaatgagctttatatctagtaaacgcatagacaatagccgaaaatcccggttcgaaatagctccagccatttcgagctataaaatcagcattgggcgacatggaatttaaataagtttccttataaagcagataatcaacacctacatcataacgaagtcctacaaccaatgtataaatcaaaatcagtaatattccggttgatggaatagggttatcaaaaaattttattctataattctgataacgcccacaaaacacaagacttacaagaaaagtcaaatacacaaatactgaaaatatcatcttttacctataagacttaaaatacaatcatccattttatcactaaacctaagcaccccgactgccaatctataatattcccaattagctaagtaataccccatccgatgataaaatctaatttgaaactccttcaaacacctattactctccggccacaactctctccataaattgaaattccttaaattcttatttactaaaaatgctttttttgcgtaaaaacatcggcgcaagaaaggtatatgatataatgaataaagaccttgttccttcaaaaaagattcaataagcacacatgcaccaatcatatcttccaattgcttcatagtagtatgatgagacacagaattcatataaataacataatgataaaatgcctcttccacatacgaaactcgatgtgcaaaacaatgcaaccttacagaagtacacaaatcctcccacatacttatcccaacaggaaactgaatatgattatcctcatacaagcttctccggaccaaagccccacatacactggaatggagtttccccaccaacatctgttccacaatgttccccttatgtctgaagggattctgactacaacgaatacgtttaccttgtttctcctcataataatcacacatcacaatatcagcattgtcttcacgagcttttatgtatagtttttcatacatatcaggatctacccagtcatcaccatcgcaataaataatatattctccatcggctacctcaagccccgtattacgagccacaccagaacccatgtttttttcatgagaaatgatttttatgtctgacttccgttgcggatattcatctatgacagactgtaatatctgaatactacagtccggagtacagtcattcacaaaaacatattcaatatcttgcattgtttggcagaataaagaacgggcacagcgttctatatatttttcaactttataaataagaacaataacacttactttaggaatattcatcaactacaatttattaatcagactaaaagatttttttctccactcatacagcctttcctccaccaaattccaatttaaattagtcatacccaattcttgattttcatataaacatttctccaatccaaacattttcaacaaagatttaactctggccaaacctctttccttattccccacaaccacaaaaggtttatgaaacaatatagaaaacacacaagcatgaaaactatccgtaacaaccagttccgcatccataaagcctcgcagccattgttccaccggcggctggatacgctcagccaaaggtgcgctccaatcttccacacgtgaatttccgcggaaaggaaccaaccccgtctcactagccaaccgtgatatcagatctgttgttgattccgtttcatccaagatatagcataacaatgtacctttgcttttaggaatatccgcccttttcaccaaatctacataatcctgaacatccaaaagcatagtggggtctaacacatggctggcattcactccaaaaaacttacgacacagttccactgccgattcctcacgaacacttaccacatcaaatttccgtaataattccctacagcgctcagtctgcccgacagtatattcccactcacttgttccaaaagaagcagcataagccattcgtttaatgttccaatcttttgcaaagtccaaatatgcattctctattctagtcggataatacataggacgccacacctggtcactacccaccacaaaagcatcaaagtccttttctttcaaatcgagtaatttcccgacctcaaaacaatgaatgtatttatttataaattgtaaagtatattgacctacaatcggatatacacgattatggtacgattcaaaaaaaaccggttcattcttacccaatatatatttccttatcatccgtttaggataagaataaggccatttccatacaggcaattcagccttattggatgtagttatcaccgaagcttcatgccccattcgttccaataccgtctgcaacgcatacgcttgaagtatccctccataattagtatggagaggcaatgtcaatattccaatcctcataatttaaaccctcttaccatctactcctcaaacttctctttctcccccgccaaatactcccacgagttctccgtcaccacattccaccactcgcgtttcaccgcctctatctcctcgtccattccgcaatcgccataattttccaccaaagaatgcatgatagtagcataaaaattcagattgtcagtttacttttaagagcactgtaatagctacgttccgtcatgtggatagatttacaaaattcttttacatttacgccactggcttttctaagaaccttgatgctctcggccaacttcttcgtagaaaaattcctgtctttcatcttttttcagtttaaatatcgttaataatactgtctgtttcctaattgtctgtccacagtggacagacgcatctgttttttcctttataacttcaccgccattattacaaaaacaaagtgcacatggctataaaagcattgaaacaaagcgtctccatcagcgaaacgcagaaaatgatccaccagtggaaaagacggggagtgaacgatcctaccatcaccaagttactggatctctacctgggaatgcctgcttacatgaactctcaaggcatctatccgctctgcaatttctatgacctccggttgtcactccgcttttcgtacacatcggcgctggtggccgcagtgacaaactgccagtctttcggaatgatatggaacgaggcgcacaccaaaatcattgcattttactcaccgctatggtatcacaaagaggatggaaaaccgatggaaccaccgcagcatcctgcgcggaaaacaccgcaagatgctgcttttaataataatatagtatataatataaataatatatatcctccggaggattcccgtcagggatgttccgccggaaacggagtgccaaacgcgaagaaaacgaatactccaaggcccccttcagaaactccttcggaaacgcctgacggcgagaaaacttctcagactttatctcctgccaccgacttcttccaccggctcaacaccacccccgaagacaagcagcgggtgctgataccgctcatcaaccgcatagccaccagtcacaactacacccgcccaagggcattgcaaacactggtaatcctggtgaaccaatttctcattccccacttcaatgccgatccccgcttctcacggaactcgcacgcaggaagaatcatctggctgcaaaacctcatgaagacgcgccacggacagtcgttgatggaacaagccgtcgcccggctgagcagcgagctgagcaaagacctggaggagaaacgtaggaaactccgtgaattccgccccgtctcacccttcgagtggaaggacgccggcacggatatccgttattacgacgaccccatagacggaaaagtggagataccggaaaatgcgccgccacgacctgtcgaaaccgccatctggaacgtgctgtccaaagaatggatagacacgggagattagtggttagtggtttatgattagtgggctgcgcattggctgcccggcatttattttttaatttttaattctcaatttttaattcaaatgaaaccttattattctctctccgactttcccgaccgtaagaatgcgggaaaaaatttcattgcccggtgtcccaaatgcggtaccatgcatctgtatatctcaaaagccaaagggctgtatcattgcttctacgccggatgcgaattcaatggcatcctgactgattattgcaaagacaagcgtcccatgttctcttaccccaaagaaaagtcgtccgatcgaaccggaacatacctacctcccggaacgcgccacctcacaggcaacctgccggaatatcgaaatgcgacagaaaacagcgtaaacgaagtccccatgctgccgggcgattacaaaatcctatcccccgccgtgttgcaaaaaatcaagccgctggacgaatcgcccgagtgtacggatcctgaccaactggcagcacgccgttatctggccgatcagggcatctctctcgccacagccatcgcaacgcatatcggctgcctgcgtcattactgcatcaccaagaacagtgaggacaaacgcgaacaggcttcctccgtctttccctgcatcgcctacgtgaactacgtggacggacgtcccgttaatgccaagtaccgctcatgcagcccctcaccatccgcaaagaccgttaccgctgccaacgcctccgcagtatccggagagatagaaattccggacggaacaacggaagaatcttccgtaacctacagcaaattctggagtcaggattcgcccaccaaaccatgcgctccctacaacatagactgcatcaatccgctgttggtggaggaagagaccattccccgactcattatcgtagaaggcgaaaaagatgtgttggtactgatggaagcaggataccgccacgtcatcagcgtgccctcgggagcggcaagcgacctggcgaaaagcttcgaggcattcacttcctggctggaccaggtgcaggacatcgtgatctgcggtgacaccgacctgcccggacgcacactggtgaaacatctgtccgactacttcggagcacgctgccttttcaccaccctgcccggaggatgcaaagacataggcgatgtgatgaatctttacggcaccgaagtggtgcaaagcgtcatagaagatgcctgtgcctgccacaccaccgatatcatcactgtagaacaacgcagggaagaggtgatgaacgtgctgcacggcaaatacgaccacggctacagcgtgggctacggccccttgaccgaccgcgttttccatcccaccgacacaggcggtctgatcatcatgaccggtatgcccaacagcggaaaaacggattttctgaacgacctgaccagccgcatcatgcgcgacacggaacgctttgtatgctacctctctttcgaagttccggacaaggacaagcatatagcacacctgatacacctgctgctgggcaaagccaacaccaccgcctataccgacgagcagctgacaccctatattgattttctgaacactcacatgattcatctggatatgcacgaagtgccgcccactcccggaaacattctgcaccgggccgatctggtacgccgcaggcagccgttgaaatatctggtgatagacccttatctttttgtagaggcgcaaagcggaaaaggcgagaccgaaacccaaagcatcaagtcgatgctgacccgtttccagtcgtgggggcgcgagaaccatatctgggtaatcatcgtggctcatccgcgcagcctgaagaaaatagacggaaagaacgcaatggaggacatcaacatgtacaccatatccggcagtgccaattgggcgaatctggccgatttcatcctctccatcacccgtataaacgaacccgaccgtgccttcacccgcctggatgtgctgaaagtgcgcgaccaggaactgtgccgcacaggaaccgtgtactacacccgccagccctgcggacgttatgaagagcatgagagcgaagaggaatgtagtagtaacaatggttaatccatacggcgacgtcgcctcacatatacgtctgtgtgaggcgatacatacgtatgcataggtctgcacatactgacgtgtagaaccaagcatacggacgcccgactcctacggtcttcccaaataatggaaaatcaaccccacttgtaccgaattgaaaatacgctgtctgtccgcatatcccgaatcgagcaaagcctgataaagcggcttatgatggtgtatccaggcagaaaggcggttcaatgctgccacaggagtgatatcgggggcatatcccatggccaaatcccgtttgtaataaggcttcaccggccattcgcccatatacgtttcttcttcgttcattacattcacttttttaaaacgtttctattatccgtaaatatccagctattacaactcctttgcagcaagcttattcacagagattatctatcaaagcaaatgtaacaaaaacaactcacatataaaaatatatcaaaacctttaattcactttatttcattctccgccacaatgtgtcacacaccttcatgtctgtttatttcccttcatatccacacctttccgaagtgttatctttgtcatgttcaattcatattaatcatttaacaacaaaatcattatggcattaaattacagtgtttcattacgtcccaatcctctggataaggatgcggctcccaaagcttacgccacctcacagatcaatggcgaacttaccttgaaacaactcagcaaacgtgtttcttcacagactaccgtgagtcgcgccgatgtggtggccgttctcaccgctactgtagacaatctgctggaagcccttaccgaaggaaagcaggtggatttcggtgaactgggcaagttccgtctccagatagccagtataggaacggaaaaactgacggatttcaccgccgcccatatcaccggagtcaatatccaatatgttcccggagaggatttaaaaaccatcttcggcacactggaattccaacctgtagccagccgtgccgcacaggccgccgcactgcgtgccgaaaaggaaggaaaaaccgtggcagacctgctgaagagcaaaaacgaaccggaagtctaaatctttaatgtatcacacttaaaactttatcctttatggaaaatcagaaaagaaaatctacttggagcaccatcctgaaagttatcattgcagtggcaactgctataggcagcgtcataggtatacaaagttgtatttaaccggccggtatgcgcaagataacattgatcatcatccattgttccgccacccctgaggggcggaacctggatttcgagacctgccgccacgaccatatccaccaccgcggtttcaaggatatcggttaccatttctacatcacgcgcgacggcgggattcaccgcggacgctcgctggagcgaatcggagcgcactgcaagaaccacaaccggcattctgtcggcatctgttatgaagggggcctgtctgccggcggcatacccgcggacacacggacactggaacagaaagcgaccctgctggccttgctccgggagttgcgggctgtcctgcccgaagcaatcattgtaggacatcgggatttgaatccgctgaagggctgtccttgttttgatgcggtgaaggagtatggggggttgtgaaaacagccccttacttcaattatgtttctaccaaaacaaacaaatccacgccactctcgtacatttcttgcatttcatcctccattgcacgttatacagtagtatttcccgacttcatatccacgaaatagatagcaacttcatcattcaattgctccaacagggcatcgataatataagggctatgagtcgtgatgaaaaactggttgttcgtcaagtttataacactttgcaccacattaatgacactaagaggatagatgcgcgcttcaggttcctcaaacagcaatttgctttgcttgttgcttaatatggcagctttataaaatatcaaccgctacaaagtatctgccccaaaataaaacggtatcaaaaagatttctcgttgattcaattccctttttaatttgttttctatgcaaagaaagaaattccattccgtttctcctaatcattacagtagcgaagatcggaagtattatggttgtattcaggatactacaaagtaccattttaaaaatggtatgctctaaattgcttactattttattacatttaccttttttattaaatgtaacaagcctaacataactttactttagaccagataaaattctgtattttttttctcataatctcatctaaaccaactgtatatatagaaataactactattacaactaataacaggagctcagaaacaaagccttttacagtagaagaatctagcaatttattcatgaaaaatgatggtattgcagcagatacagtaacccaaaaacatcgtataaaaactgatagtatttcattccacttataatccactattttcactataagcaaaggttttatcaataaacccgcaagtacataaacaatgagatatgcccaagaaagtgctacaggcgagaaaccattttcaaacaacaaataaacgacagggaaagccaatagattcagcattggtgatattaaagcattttctttcaattgtccttttgcatataaagctgtataaaaagacacatcaaaaacctgaaataaactttgtacaatagcaatctgaaggaatattgtagtatattctggaacattatcacctagccaaatatacaacaaaggatcggccaaaaagtacataggcaagctcataaacaacatcaaataataagaatacttagttgactgtaataatagttttttagaaccttgataatcattaatagcataaagcttcactatttgaggatttactgcagttctaaaatttgtcactagctgatatgccgcattattaacctgcaaagatattgctcttgcagaaactacagcgggaagaaagaacatatttaaaagtatgagaattccttgacttgatagcgtactcgaaattcctgcaaccatgctccaactagaaaatgacaaaattggtttgagaatccttttatctaaagagatttgatattttgcttctgcaaacttccttgagcaataaaatctataaaacaggagtaaactcatttggacaataaatatcattgttgcataaaccatcaatctatcaaaatcaccgactcctattaaataacagattcctagcttagctacaacctcaaaaacacttgtatatgcatatatattcatcttttcccgcgctattataattgcgctatacggtacttgagttaaagataaaaatgctgcaaatattgataaatgaaatgcatatacagcagcactcatacgatcaggaggtatgaccattttattataaataaaccacgtcccacccgtttcggctaagaatacaataaaaagtgctaagattatatgagaagtaagtagtgtggaaaaagtccgtttcaatttttccatattcccagtaccaagttcgaatgttagaaacctagaagtaccagtacttaaaacaccattgataaaagacaaaaaaccaacaattccgccaacagcctgatatataccataatcatcaacacctagtttttccaaaataatacgtgaagtgtacaaagtcacaagcatcataactatcatacgggaatatagataaatggtattcttggctatgcgtctattatcatcattcatattaaacttttacgtaatatatagtctgaatttgtccccttccaatgagcgtagaatgcaccactgagctttggaatgactgtttcaatcattgtttatggatttatctctatttttatatgcaaagctacttacaatatagaaaaatcacagttatccggatcatatcttaatcttgaattaatatttatggcatcaatcgccttcaattcatcatcagtcaaattaaaatcaaaaacatccaaatcagccatttgatttttcttatgtctagctccaactataggtatcctgccattttgtatatgccaacgaattacaatctgaacaattgttttcttatatttttctgccattcttttcatcaagggtagtcttgtcatacgagtatcagccctagctatgggtgtataagcctctatttggatgccatgctcattacaataatcaacgagttctttctgagtaaataacggatggcattcaaattgattcaaagatggcatgacacctgtttcattatacaatgtttctaaatggtgaatattacagttagcgactccaattgttttaacataaccttcttgctgtagcttaataatttctttccatgtttctacgtatatatctgttacaggccaatggaattgaagcaaatcgacataattggtatcaaaagcttttaatgtcgaaaaaaattcgtctcttactctatgctctcgttgagctgtattactaaccctagtcgtaagaaataattcttctctcctacggtttgattttaatatagccattcttactaactgactggaaccataagcagcagaattgtcaataagttcgaatcctaaatttatgcctcttgcaacattattaataaagacaagagattccttttcatatattaacttattcacaaccttttgtccaattttaactattggattggaagataaatgagcgtaaggtaatacttcctttcgaactacagctcctggtcccaaggctataacaggcagcttatttccatctcttagtttgaaatattccatacataactaatataaacaagtaagaatacaactatttttgatcatgtaaaatggctgtttcctactctaaattattattctgtcacaccattttttttcagtaaagcttcgatactttcaatggtactgaaattttcaggcaagatatcaatgccatctataactatattaaattcggtatcaagggcatcaacaagacacaccacatcaaatgaatcaagcatgccttcctcaatgaagttgagactttcgtcggtaaaatcgaattctggacgaagatcacttaaaatcgcaataatcttttctttcatttttattttagttttaatacgtaatcaaataatttttctggtttgaaaccataatgaacataacgtttgatagcatttatattatgagttattacccataacaactgacgtttggtatttcgtccttcatacataaatgaattgaataacttagatcctatattcatttccctaaactgaggcaatacaaaccagtaacgcaaatacaatgttaagcccgtaagttcaaatatgataaaacctacaatcttgtgttccagtttataaactaaaacccatttgttttgtatataatgtgcaatttcttcaatatctggaatctgttcggataaagggtcaaaattagaatataaaagctgaagaataacaaccgaatcttccggttctgcaaatgtaactcccaatcccggctgaatcgaatcaggcaagccaattcggctcatccgattaagttcctcatataaaagaaagtcattgtcaaaaaacacttgtttgatagattctattttggagtcttccaaaatatctaccattacagttttcttgatttgaggagttatttcttgcaatccttttcttaattggaattcgtctgttgtaatataaaacagataacttgccattgaattatttctaaaaataaaatatccttcagtagtagcttgataaaacaattctttcttttcaatccacaaattgtgtttttcgaaatgcagaaataaatttgaaatgaatcctttacgtaaagaacgtatttcagaaataaaagaattaagctgatgatatgattgtactaattccatttttataatattgaaggaggaattaaggatagtttcttatccattaagtaaagctgtataatattttctatctatcttgccgttagcattgatttccattgattccacacgattgttaaccgtgggcatcatataacgggggataaacttcaagattgacttacggaattcacctaagttcaaatcttcatgagactgataaaagagaacgatttgcttgtttttaaaatcatatacaacacaacaactatccaccatatgcgtacctaatacagcattctcgatttcacccaactcaatacggtaaccgctatgtttaatctgaaaatctttacggcctacatacataatctctccctgctcattcttatatactatatctcctgtacaataaataatttcaggataaactgagtttagaggattctgtataaatgcagaagctgtacgttcagaattgttataatatcccaatgctaacgatgaaccacgcacacatagttcgccttcttcattgattgcacattccttcttttcatcattaagaatgagtacatctgagttacgacaagggaaaccaataggtaatggatcactatctgcgaattcacgttctacaatataataggtacagtctacggtaatttccgtaggtccatagagattaacatatcggcaactaggcaaatgtttacgccaataattgaggtgcttgttaggcatcacttctccagcgaaaaacacatctttaagatattctggtttctttgattcaaaaatattgaaattggccacattgacaagcacaaaaggaacccaaaaaacaaaagtaacatgatgttcattaaggtaatcaaccaattttgctgggaacataaagttcgactctggaatgatattcaatgtagcacctgtagccatcatcaaataaatatccaaagtagagttatcaaaatagaacggtgcttgattaccaatcttagcatcagctgtaaaatggaaagtatctaccgcccaatcaatataatcaatcacaccacgatgtgaaatcactacccctttaggaatacccgtagaaccagatgtaaaaattgaatatacaggatctgtatctatctgtctgctccttgctgattccactacagataaatctgcctctttacgcgaacaaaggcatccaacagtcacagtgggaaggccaaaattttctacctgatctttgtgttcttcgtcagtgataatcaatccagggttaagcgtagccaatatattccgtatacgagtgtctggcgatttaatatccaatgggacatagaaatttccactatagttagtaccaacaaagctcgttaccatctcttttgacttaggcaagtaaacacaaaccggctgcttgaatatattctgttctacacaaaattcagctattttcaaagcattgcgtttcatttcaccaaatgtgatacaaccatttgcatcttccactgctatcttctcagaatataaaccttcagtgatatccaagtattcagttacattttttctcatactattttttattaacaggagcataaaaatgagttttactaaaattagtagctatgctaccgcaagtcaatcctacaccaaacgcacaaagtatggcacgagagggttgggacatctgtttgtcaccatataaatcacacaacaacaaaggaattgacgaacatcccgtattgccatattccttcatattagtaggaaatttttcaggcgttgatttcaaagacatccgtacatttttaataatcatctgattggactgatgcatagcaacaagctcaacatccttttcttcccaactttccttttccattacattcaaaatactaatcttagcattgacaataccatatgtgaatacagtcataccatcttgatagagatatccgttataaggtatcataatcctatctgctttagaaccgtttgaagaaagatgaatggtcatatgactatcaccctgcgctaccaatgtggcagtagcaacttcgctggtttctatgctaccaacagcatgagagtctaggtatggagtcagcacttcgctacacaagacaagtatatttctgcacataccacaattaatccatgctgaagcttgcaacaaaccataaatataacccgtacaaccataattaatatcctgacaaaccgtttcagtggacaatcctaaccggtgctgcaatgatactgccgtatcaggaataatccattcacgggtagaagaaacaaaaacgagtccgtctatggagctacgatctatattatccctctctatcagatgttctgctgcattaaaacataaatcagaggctttttgtccttcttctgcacgatacacatattcagcaccggaggacctgatcacatccctcacttgcttttcaggaaaagatccgcaaaatgaaagtaatgatatcttatttgcaggtaaccatgctgctacgcttttaatctctacattccgtatagttgtcttcatgcctgacgttcattgaccagattaaacaaatcttctatagtatctgccttgcgcacatcctggctgtcaagttccacgccgtattcttgtatgatcatagctaccacactcaggcctgtaagtgatgaccatgaatccaactcatgataatcggtatcagctgtaaaaacagaagggtcttcatcttcaaattgggaagcaaacttgctaataaattcttgtaaattcattatatctaattaattatgatttccaataaacttttgtttcaattactttagcggggtctccactcacaatactaaaactggggacatgaccttgtactactgaacgggcactaataatagctcccgcttctatagtggtccctggcatgatagtacaattttctgtaagccacacatgttctttaatcacaatgggaatagaggtcttgtaacctctgatcgaaatgtgatgttctccattgttatcgcgtatagtcacatttcgtccgccacctgtccatcttccgatagagatatggttggcacaaataagattcagaccaacatttacagaagcgtcacctcctatctcaagatgagcacctttgaaaacctgtatatctgctccataataaaccgtatagctaccgtacttgatttccatccttccattctcctctatcaacaaacggctttccaactttgatccttttattcgtttatagcccataatgaaaggagcatttaaaacaagtttagctttggggtgtaaatcaagcgtacaatatttattgataataataaattttctttctaatatgtctgtttctatctgacggcagaagagattgtatctcatattctttatccaagttcctatattccatcctgccgcccccgtcacaccttttataaaacaagccacattcttaattttttctttgagtgacttctgagtttggccaaagtcaggcatatatttatcaatacaggcctgaaaagaaatgttcaaggtcttaaaaaaatcttctctgttatgctctgagtgctttaaagaatacatcaaatgataatttcctttggtcgcctcttcaaaagagaaatcactccaaatgatctttttcttgcatttgtttagcatatcagctcctttttcgttattagcaaagacaacagatgtgcctatgtcagagtccagttctttaggtatgctaccgggactagaccataaatcacctatcgtcaaatccgatgttcgtggaaatcctttgaaaggacagtcaaaacaactgggacgacagacttccggtattttatattgcatggataaccatgggttttctttcccaagaatataatcgacatccttgtttgcaaactccacacgagtggaaagtgttctccaacctaattccttgcttttcgctttgtaataaaccaccgttgaatgatgcttctgctccaaatagttgataaactgcttaaaatagagaggagaagcaatgccacggcaaatatagtctaccaccatcagattttcataaggcttacgaagaaaacgtttcatggctgccatttgacagggacttccacaaacaagtacgggtttgccagtcttcagagcttcacgaacagcgatataaaaaccatcaagatgactttgcaaatatttactggaacgcaaacgagacaaatcttccctgcttgaagacaagaactgagatacagaccaatcttcattataaatggctccacctacgtaaccactttttttataaatctcatcagccaaagccgagaaagcacctccggaagtactatcaaatcgcacttctatattcttattaatcaaggcataacaatgaggcttttcaaatcctccactttcatgccagtcttctttattgattatcggacacaccttctcgcacagtccgcaatcggtgcatttgtctttatcaacttccggataccaaaatccttcaacatcaatatgaaatttgatggcttggtggatacacacatccccacaagcattgcatccacaacatttggatttatcggttatatttaccatttgcaagtatataagatttatattatttaggactgtttatttaaagcatatatctttagcggaatgcttttgctaagggagtattctactacaaataagcacacgaattaataagttaacacttgacagaaagccaagcagataaaatgtagagaatatatcccataaacttgtcacaaggtcatacccaagcctatgagagtagttccaccgatgatatatgaaaacagttcactaaaagacatattttatattagctgacgaattttgatgtatctcatataaaagccgatgaccatcggctataaatccttataaccgatatggtcgttctgcctgataaactgatagaaatgtttcctttataaattaccatcactctatcttctcaaacggaaatgcatgaagatagctcactgccaccgtcatatttccgaaagcgaacaccagccgggtattccggtgtaaacgcatgatgcacccttcctttccccgaaagacgccaccggtaatacgaattttttgcttcttctgaagatagtcctccaaaggacggttcatcagttcgatattgtaaggcatggattcgtacagatagataaattcctccatctggctttgagggatgacagccgcacgatgcgtgttatagtccgtcaccagatactggcggggaagcatggcagacagaatacgctccaactgatccaagggagcacagacaaacagccagccattacctgcaatttccttctcgtccgtcaaagtattcaatttttgggtggaaccggtagcaaaagcctctttcaccacccgggctgagtcacggcgggcagtatattcctccttggtataagcacattgctcaaaacgtttcctatgatcggcagctgtataggaaaacactttgaaacagaaaaattcctcctctacactccccgatagagtacggaaccggacagctttcctaccgctgaatacactgatatagcgtttcagctctttattagacagatacagatagtaccaactgagttccgggtattcctttcctattcccgccaatggcgtgactccttcatttgaccccaggtctgagccggaagcgattgaactgcagagcagtaacttaggcgcttcgctcgttatgttttgattgtctgacgggagtacttttacagattccgcatcgctctttattgccatcaaaacattacaatttaagttcataatcttgaaatataaggctcaggcaagcccttaaatttcttctttttggaggggttctcttcataagagaaccccaatttgctgcaaatatacgtataattcttcaatctgaaagttttcgcattagaaaaagtgtcttcaaattgccttaagaatgattattgtttgcaaaggttttaattctaaggaatattatgtaccacattatcagctagttaagataaattggggttctcttatgaagagagccccaatttgctgcaaatatctaaaacaagaaaattttgattatcagactattatatcatagacctacttaccgaaatttattcttcacattcagattcccgtaatatcatttaagattggatttattggcaattacagacaagtacctttcaataaaacaatacattaacaaagtaaacacgatttaggatacaccctttaattaagacacttcactgtgtcctgcacatataaacagccgaccgtactgtcataaaaaagaggaagcgtcctcttctgagattacgcttcctccatccatactaattaaatcttaactttgcagcctgaagactacaggaacagtgtatttcaccctcactgcttttcctctttgcttgccgggcttccattttggcatggaactgatcacgcggattgcttccttgtccagatacggatccacactcttcaccactaccggattcaggatctctccatgaacacccacaacgaactgcaccactacccttccttgaactccctgctcggcactgacggtaggatatttgatgttttcactcagatacctcatcaaatcagcattaccgttacgaaataccggcatctcttccaccaccacaaattccacattttcatccactacttcttcgggtacttcaataggggtcggtataattaccggagcatccgtagggtctgaagctgcaatatcggtttctgtttccatcgagttattatccactatattgagctcttccgggttgacggcagccggcggaggcggcagaggtttatcctgattataggttacaggaactaattcttcaaagaaatccgggtcactgactaaatcactgatcgcgtaagttacattacgttcagtccattcgaacgaaacaaacataaacgacagcgtcacaatgagacccatgaacagccaacgggacttacccttttcaaggtcggctcttcgtgcttttttcacttccataacaagtgttttttaaattagacaatatgtgagtaaaaatctcagtgtccgcttttaaactggaagtaagatagtaaaaatatagataagttaaaagaaaaaggagtgtcttatattattttttaatataaaacaccccaaattcaattccgttaaacaattaattaaaaatcagctgtttatttagttaatattcaattttacgttaacatatcctgcttactctacggcaatgccggtttccgccaatacagacatcttttatcacaagctcaccatctcctgcagaatacctaccgccgtctctaccgtttccacattcttgactaccatactacgcttgccgttctgctcacgcaaattgcagtaacgcggattcttgctcatgtaatcaatcaccttgccaaaagccgcactttgataataaggactttcctgattactgataaagaacaaagtcattcgtccggctttcaagaatactttttccacccccaaccgtttagccaatctgcgcaaaggtacgatacgcagaagttccagcccttcgggaggaacctttccgaaacggtcctccaaccgtgccttgaaagcgagcaggtccttatccaattccaatccgtccagttcacgataaagcaacatacgttcgctgctgctggggatatactcattggggaaaagcaattccaaatcactttccacctgacattcatccacaaagttctcgccactgattttctcttctcccgctgcctgcaactcctctgcataaagatcggcaaactcatcctctttcaactctttcaccgcttcggccagtatcttctgataagtttcataacccaaatcggcaatgaagccactctgctccgcccccagcatatttcctgctccacggatatccaaatcctgcatggctatatggataccgctgcccaaatcactgaaattctcaatggcttgaagacggcgctttgcctcgggagtcagtgaagtcaatggaggcgccaacaaataacagaatgcttttttattgcttcttcccacacgtccacgcatctggtgcaaatcactcaagccaaaattctgcgcctggttgatgataatcgtattggcattcggtatatcaatgccactctcgataatggtggttgccagcagcacatcataatcatagttcacaaagtcgaaaataatcttctccagcttttcgggctccatctgtccatgacctatgcagacacggcaatcgggtatattccgcttgatcatggcttccaattctaccagattctgtatgcggttattgacaaagaatacctgtccgttacgactcatttcaaaattgatcgcttccgttatgatatcttcattaaaggtatgcacctctgtctgaatgggataacggttgggaggcggagtctgaatgacagaaagatcacgggcgcccattaacgagaactgcaaagtacgggggatgggggtagcggtcatagtgagtgtatccacattcactttcatctgacgcaacttctctttcacactaactccgaacttttgttcctcatcaatgatcagcaatcctaaatctttgaacttaacgcttttaccgatgattttatgtgtaccgaccaaaatatttattttcccatccgccagttccttcactattctggaaacatctttcgcactgcgggcacggctcaaataatccaccttacatggaaaatctttcaaccgttcgctgaaagtctgaaagtgctgataggccagcaccgtagtgggaaccagcacagccacctgtttgttatcagccacagccttgaaagcagcacgaatagccacttcagtctttccgaaacccacatcaccacacaccagacggtccataggacggtcgctctccatatcggctttggcatcctgagtcgctttcaactgatcgggggtatcctcataaataaagctcgcctctaattcatgttgcataaaactgtcgggactatacgagaatcctttttcctgtttacgttgcgaatacagtctgatcaggtcacgggctatatctttgattttgctcttggtacgctctttcattttttcccacgcaccggtccccaatttgttcaggcggggagtttctccctccttccctttatacttggatattttatgcagggaatgaatggaaacaaataccacatcctcattctgataaataagtttaatcacttcctgggtagtatttccattcggaatgcgtaccaaaccgccaaaacggcctacaccatgatctatatgtaccacaaagtcacccggctcaaactggctcaactcttttaaggtcaatgccaccttaccgctacgcgccttgtcactacgaagattgtatttatggaaacggtcaaaaatctgatggtctgtaaaaaagcagcttttcaatacattatctgtaaagccctcatgtaaagtcttgttgaccggaatgaacgtgatatgatcaccacgctcctcaaagatatctttcagacgctttgcctgcttctcactatcggtacatatatataaggtgtaacctcgtttctgataatcagtgaatgaagtgcttaccaaatcaaaattcttatgaaaaataggctggaccgtcgtatcgaaagccaacgttgcctgtggagttcctgtaggtttgttaccaaattcaatccgtttgaaatccaaagcccgtactgtaaattccgccccgtctatcagcttcagttccaaattcatcagttccgtcttctctccctcgtatgcggcaagcgcctgaggagagagtgcctcctcccgtactacctgtattctttcacgtacccaaagaaagtctttcattgccagaactgtttcctgaggaatgaattcaaagaaagacaccccgctcttgtcggcggcattcgtcagctcgggcacgatggcaatgctctgtttcttctctttcgaaagctggttttccacttcaaaagtacggatgctgtctacctcgtcaccaaaaaagtcaatacggtaaggatactcggaagcaaaagagaagacgtcaataatactaccgcgtacagcatattgccccggttcataaacataatccacatgctcgaatccgtaaccggccagcacttccgtgataaactctgtgtccacatgctcacccacaccaagttttaacgtcttgtccatcagtacctcttgtgataccactttctccgccaacgcttcgggataagtcaccacacatagcggatcgcctttctgtaaacggctcaacacttccgtacgcaggatctcattggctgcatctttctgcccatatttaacagcccgacgatacgaggatggaaagaacaaaatatgctcatcaccgttcacctgtgtcaggtcatgataaaagtaacccgcttcctccaagtcacccagtacaaatacaaatgtctgtttattctctctaagaaaggaggaaacaaataaagctgccgcagaagcatgtaatcctcccaggaaaatagtcctcactgaggaatcttccaataacgcagccagtcccttagtgttaggatgaccggcataaatacgttgcaattccgaaatatccatatctttttttaagatggggacaaaattaaagaaatatctgattacttcctcctttttttgccaactattcaagattttcctatttttgtacgctaatatataaccccatggaaacaaaagcaataaacacaaaattgaaaggacacgcacgtgtagatgtagctgatgtgctacgcggactggcagtgatgggaatcatcatcctgcactctatcgaacattttaatttctactcatttcccgatacagccggacaaagtgcgtggctgaacttctcggacaaagccatttggaacgggttattcttcatgttcggcggaaaagcatacgccatattcgctttacttttcggttttagcttttttattcaagatgacaaccaacgcctacggggcaatgatttccgtctacgtttttgttggcggttaattcttcttttcctgataggtaatatcaatgccagttttttcacagcggaagtgctggtcctttattctttagtaggtttcatcctgccactgacttgccggctgaaagacaaatggatatttgcattggcatgtctgctattgatccagccattgccactttattatgtaatacgtgcctgtctcgatccggaatttgttactccggccatccccacccgcagcttctggaatgcaacttttgcagtgcaaagcaatggtaattttctggaaaccatccgtggcaatttatgggaaggacagttggcaagccttgcctgggcttgggatcacggacgggtattccaaacagccgcccttttcctgctcggtatgctgatagggcgcaagggactttttttgaaagagcacttgaaggtatggaacaaggtacttgcaggctcactcgtcgcatttttccctttatatgggttgggcaatatgctaccggactttatcacaaataaatccattctgacccctctttcactaatcatcacctcgctttccaattttgcatttatgctgattctggtatccggtgtcgtcttcgctttttacaagacaaacttacacgacggattaatgaaaataacgccatacggaaagatgagccttaccaattatattactcaaagtatagtaggttccatgttatactacaactggggatttgcattgcacaatcagtttggcatcacagccagctgcctggcaggaatagttttcttcatcttgcaattctctttctgccgctggtggatgaatcaccactctcacggtccgatggaatatatatggaaacgggcaacctggctgaaataagccaagaaccgaagtctgcccgcatttgtttataaaagacatacaaatagaactttaaaatatgcgcgaagaaatcataaaactattagaccaatatcggttaaaagaagcattatcccaaatgacaggatatgccacccatacttccgactggcaattaaagaatgagctagaagccctgcaaacgtcatacgacctgatgctgcaatatacttcaaaagggatgaaagatcccaataaggtggaaatataccataaaatgttacgcacggcatacgaactggccgaccgtatccatatagccgtacaggcaacacaaaattacggagcctattatgacacaatgcgcacttttgtccaaagccctcctcacagctatgccgaattacaaatgcaactggaggcgtatacagaagatatggctacagcaccattgatatataccaccgaggccaaaataaatgaagaaatggatgccatgagaaaacgtcacgaaacagccgtagacgaattatttgaaaaaatatgggtatccacccggtggagtgaatcggaatatgctgaagcgcaaactttgttcaactcactattgatccaagtcaacgacctttccataatggtcagcgccgttaccatgagcctgctgcaaatattcgacatccgcaagttcatgtttctattgaacgcctatacccatcaggataccatgctgaatcagcgggctattgcagggatcgcactaacatgctactattatgaaaagcgtatccttcaataccctgaagccgtgtcgcgcataaatgaactgaatgaaaattccgagttcatcaaaaacctgcatcatatccagattcaattattgcaatcttcccgtgaaacccgaaagatagacaagaagatgcgtgaagaaatcattcccgaaatgatgaaaaatcccaaacttaatttggaaggactggatgaagatgccgaagatcataatccggaatgggaagaatggattgaccgttcaggcattaccgataaattgcgcgaattaggtgaactgcaaatgtccggggcagatgtgtatatgagtaccttttcacagctgaaacaattcccgtttttccgcaaaatttctcactggttctatccttttgatccccaatatcaggatatcgccaaattatctctcggaaatgacgaacaaaaaatctctctgctcaacattttgatgaattcggatgtattctgcaattccgacaaatactctttttgttttaccatgttacaaatgccggaaagccaaaggaatctcatgcagcaacaattgaacggacaacatgaagtttctgaagaactgaaagaacgtttaaaagagatgtcacaatcaaaagcccgcgctgaattcgtgagccggcaatacattcatgacctctaccgtttcttcaaattatggtcaagaagacatgaaatacatgacatttttgaggacactctggacttatggaataaagaagcattgtctcaagccttgttacacaaagagtatatcaacaaactggcagattacctattcacacacgacgacttggcagaagccggaattctctatgataaatcaattgaattatacaatcgtaaaaatgccgaattatggcagaaagcaggtttcatttatcagaaaatcggttcctataaaaaagcgatagattattacctgcaatcagatctgctgatccccgataatacatggaataaccgccatttggcacaatgttatagaaaagagggaaactacccaaaagctttggaatattataacaaggtggaacaggcacagcccgacagtctgaatctggcactacaaataggacaatgcctgatggcactggaacgatatgatgaagcactggcttatttcttcaaagtggagtatctggataaaaagccacagaatgcccgacgcgccatcggatggtgttccttcattaccggcaaccatcaacaagccaagaaatattacgacttgctgatatccgagcccaagcccattatggaagactggatgaatgcaggacatgtgtattatatcctgaatgaaacagaaaaatcaatagaatattatcgcaaagcccaggaactatgcgacagtcatgatgagtttgtccgcctttaccaaatagataagaaagacttgataaagcaaggcgccaatgaagtagacttgtttatacttcccgatgaattaatttaaaggattataagataaatctattcgggatagaagtttggtataattatataaaacttctatcctgaccggattctcatcatccagacgataattggcatgcacattataagtgcttaaaccatgattcatacaatatccgatatcattaggtaaggctgttctattcctcaactgcccaagattcaataaaaaatagaagaaactatccaccccatcataatcaatcacataagcctgtaaattcagattcgcctgatagttgatgttattatcataattataataagtatgacaactggacacactatcatttgcctcagtaaaaacagtcatcacctccttcaaccgtcccaactgatcaaaaacatattttccttgcactttcttcaagaaacgataatcggaagtagcacgataatcagaattgataaaaatagtatctcctttataatcatagacagtctgtttatcagcttcataaacctcctctcctaccttcaacatacaacgggccctactctccctcgccttgccttttcctatttgaaacgtaacattgcaaagcttattgccggtattcaaacaattcatctgtccgatggttatctggtcgccctcataccttaccggggtatccccatactttataattttaccatcacgatcatattccaatttcaaaacttgttcttcctctcccgttaaatcggtgaccttagtcacatatgtgtcagcttttttttctttacaaccatcagcaacaaacaagagaactaacaaagaaatatattttacaaataactttattttcataagtcaagtatcatctctatgcaaataaaataaaaaatattagaactaagtacaatttggagctttttaactcaacttctttacccccactctgttttaaacagcaattataataagaaagaaatatggaatggattatacatcttttgagacagcattcagaactggcgatttttctgacaatcgccgcaggcttctggattggaaaaatgaaaataaaacaattcagtttgggaatcgtcaccagtgtattgctagtaggggtattagtgggacagcttaacattacaatagaagaaccggtgaaatccgtgttttttcttttattcctttttgctatcggatacaaagtgggaccacaattctttcgcggactgaaaaaagatggtttacctcaagtaggattcgccgcgctcatgtgtataggttgtttgattatcacttggttattagctatcttaatgggatataatgccggtgaagcagccgggttactggccggagcacaaactatctctgccgtcataggagtagcagaagataccataaacggactcaacatatcctcttcccaaaaaagtgatatgattaatatcattcccgtggcatatgctgtaacttacattttcggtacggcaggctctgcctgggtcctctcttctttaggtcctaaaatgttgggaggattagaaaaagtgaaagccgcttgcaaagagttggaaacccggatgggtaccagtgaagcagacgaacccggatttgaacaggcacgccgtccggtagtttttcgcgcttaccgcatagagaacgattggtttggcaacggcaagaccgttgaccagctagaatcctattttatttcacaagggaaaagattgtttgttgaaagaatgcgacatggatcttccattgtcaatgatattattcccggacaattattacaaaaaggagacgaagtggtactgagcggaagaagagaattcgccattggtgaggaagactggattggagaagaaatcgtcgatccccaactgcttgatttccctgtggaagtactccctgtcatgatacacaaaaagccatattccaaccaaaaattggacttcatacgccgtcaaagctttatgcacggcgtcagtatacgccgtatcaaacgggcaggcattgatatccctgttttcgcacaaaccactatcgactgcggagatactctggaattggtcggcctgaaaaaagaggtggaatctgctgcaaaagaactaggatacatagaccgccccaccaatgccacagatatgacatttgtaggactcggcattttactgggaggtatcatcggagcacttgcaatccatatcggcggagtacctattagcctgagcactagtggaggagccttgatagccggattagtatttggctggtggcgcagcaaacgccctaccttcggacaaataccggaatcctctttatgggtgctgaataatgtaggcttgaatatgttcatcgccgtagtcggcatttctgcaggacccagttttgtacagggactaaaagaagtaggtcctatgttgtttatcataggtgcgttggccacctccttgcctctattattagggctgattctagccagatatgtattcaagttccatcccgccctctctttgggatgcacggcaggagcccgtactaccactgctgcattgggcgccatacaagaagcagtaggcagcgaaacaccttccttaggatacaccgtgacctacgccgtaggaaatacactactcatcatatggggagtggtcattgtattattaatcaactaaaaaactaaactcatacattatggaatatttaagtgataaaagcagcgttgcccgaatggacaagaatttggaaaagatcagtcccttcgaattaaaaaaccgtttgattgaaatggcagatgaaagtgtgaagaaaatggcgcacgtcatgctgaatgcaggcagaggtaatcccaactggattgcaacggaggctcgtgaagcattctttgccttgggcggttttggcattgaagagtgtcgccgggtcatggacatgcccgaaggcattgccggtattcctcaaaaaacaggcatagcccaacgttttgaggagtacctgaaaaagcatgaaggaaatgcggggacagatctattgaaacgtacctataattatatgctgatggaacatgcagccgatccggacgaactggtacacgaatggaccgaaagtattgtaggcgaccaatatcccatgcctgaccgcatcttgaaatatacagaaattctagtacaggattacctgaatcaggaaatgtgcaacgggcaacccccgcaaggtaaattcgatttattcgccaccgaaggcggaacagcagggatgtgctatgtattcgactcgctggaagaaaatttcctgctacacaaaggagatagtatagcattgatggttcctatctttacaccctatatcgagatacccgaattgacacgttacgattatgatgtgctcaatattcctgcaagtactctaaatgaagaaggacttcatacctggcaatacaaagtggaagatatcaataaactgcgagacacgaaatacaaagccttgtttattgtcaatccgagcaatccacccagttatcagttgaacaaagaatgcgtagatgccctgaaagacgtagtaacacgctggaatcccaatctgatgattataacagatgatgtatatggtacttttgttcccggcttccgcagcctgatggctgatttgccacagaacacaatttgtgtctactctttctccaaatatttcggagcgaccggttggcgccttgctgtaattgccttacatgagaaaaatgtattcgacagaatgattgccaatctgccccgcaaacgaaaaagcgaactaaccaaacggtatggcagcttgagtatgcaagtagaaaacatgaaattcattgaccgtatggtagcagacagccgtcaagtagccttgaaccatacagcaggactgtccttgccacaacaaatgcagatgtcactctttgcttctttttcattgctggacaaagaaaatacatatcgtcatgccatgcttaatttaatccatacccgtctgaaagcattatgggacaacacagggttcattctccccgacgatccactaagagccggttattattcagaaatagacatgctggtatgggccaagaaattttacggagatgaattcgtacaacatctgcagacaacttataatccattggacgtagtattccgtcttgccaatgaaacaggcctggtcgtattgaatggtggtggattcgacggacccgaatggagtgtacgtgtatcacttgccaacctgaacgagaaagattatatcaaaatcggactcagtatccgcagaattctgaatgaatatgctgacaaatggaaatctgaaaagaaataaaaaattaagaacgtccgccgtgaagtctgcttgacctaaccggcggatttcttttttatataaaggttttttggattatttattccaaaccttatccctactttaaaataaaatccctagctttgcagatcgaaaaaggaattagattatgaagcatatacggagcactttttttcttctaaccactttatttataatggcttcatgtggcgaagaccgcagtggggaatactatgcattaattggagagaatgtatggatagaacaaataatgaaagagcattatttgtggtatgacagtattccggcaataaaggaaacggactattttgccgaaccggaagacttcctgcaaaaattggtttataccaaggcacaaaacggaaaaggagacccgtattcgtatatagaaataaaggacgcttccgatgcggcacgttcctacctgcaacgtacttctacttacggatttgattttgaattaatgaccgatcctaccggaatctcatcacacgtatttgcccgtattttattcgtactgcccaattcaccggcctcagaagccggattggaacgagggaactggatatcagccattggcaaagaagaactgaccaacaataattacggatatctgatggaaggcggcaatacaactttcgccagagaaagcttggtttttgatgaggaaggcaattccagctggattgcaacagatacagtcaaagtagcggcatcacgccctgtagaattgaatccgttctatatagatactgtatatgaggtatccggaaaaaaaatagcctatatggtctacaatgaattcagtacaggccccaataaccaggcaacagatacagaatacagggaacagatgaaacagatattcgcccggttcaagggacagtcacccgacgcttttattctggacttacgctacaatcccggtggttatttgagttgtgccacagatttaggaagttatctggcacctgcggcagatctagggaaagtattttgcacaactttgtataatgacatcagtgacccgcaaaaaattgatttccctctcaatacaggacttgcttccgaaaacttgaacttaagcaagctctacgtactgacaagcaaatttactgcatcggcctcagaagcagtcataaattgtctccgtccatatataggtacagaaaatgtagtggtaataggtgaaacgactgttggcaaaaatgtagccatggaaccataccaagatgagcgttacaactttattttatggccggttgtggcatacgttctcaactcggcaggacaagccaactatgtaaatggaatcacccccgatttcacattgagcgaacgtaacctcatctcccctctctacccactgggagataccaaagagtatttattgaagaacaccatagcttatattacgacaggaagtatgcccgacctgccacaaacagaagaacaagtatcaaaaggaaaaattatctataactcactgattcgaagaagtatgaacggcatacggctacggtagtccgatttatccggatacaacgccctatttattaaagaccgtgtttaatgcattttaaacatggtcttgttttttctgaaaagagaacttattaaaaacaaaacgggcataacaaatgttatgtacccaaataaccattaaaaacctgacttaacaatgaaaaaagtatttattgcagcagctttggctgccatgattgtttcctgtggctctaaaggaaacaaaagtgctgaaataatagccgaaagtgaaagtgactctattttcgctgtgaacgacagcacactgggtgaattacaaacatatagctatgaaggtattctgccagctgccgatgccgaaggtatcaactatcaactgacacttcaggaggcaggccaagactcactgggcacatacaatctgacgaccacttatttaggaacaaaagatggtaaccaggcatttaccgacagtggtacagttgtaactattattggaattcctaatgacagcaccgctatcgtttatcaattaatttccgctactccgggacacgaaaagacaaactttctggcagagggtgacagtgcactgacaatgattggcaaggacttcaagaaagctgtttctaaactaaattacactttaaaaaagaaactctaattaacctggctgcaaaaaaattcactaaagaacagactgttagtgaacaaaaacataagctggccgttgtatgagagaaactagacgaaaaacaattagtattaacttaaacaaaaacttgacatgaaaaaattaattcctatcctactggcggtctttgccttggtatcttgcgagaaagacccggacatggacaaattggacaatgagtatctggtattcaccagtcatgacactagtactaagttcaatgacttcagtacttattatatccctgacagcatcctgatcatcggtgacaagaaagaccctgaatactggaaggacgagaatgcacagatcatcatcaatgcattcaagactaagatgaacgctgccggctacaccgcagctaataaagacgacgccgacctcggcctacaggtaagctacgtagcaagtacttattatttccacggttactataatgacggaccctggtggggctattatcccggttattggtatcccggctactggggcggcaattggggaggtggatggtactatccctatcctatcacttacagctatagcaccggttcattgctggccgacatgattaatttaaagaatgctccggaaggacaaaaagaaaaattaactgttgtctggaatgcatacatcagcgggttactgggcggaagtggcagtttgaatgtaaaccgtacaacgactgccatcaaccaagcattcactcagagtccttatctgaaaaaataaacgtaagtgaaacaagtattcatttaaaataaaaaggaaatatgaaaactataaaatatttaactctcagactgatggcggtagccgctatcgccatagcctttgccctgccggcaaaagcacaggtaactccgtttacctatttcaatgtagactggcagttcaacgctcctatcagcaataactttgcaaacaaagcaagcggttggggtatgaacttcgaaggtggatattatatactgccggatttgtcaatcggtgcctttatcaattatcataccaataatgagtatatttcacgtcagacactaccaatcagcaactcggcagccctgacaaccgaccagcaacattccgtatttcagttgcctttcggtttcgcaacacactatcgcttcagtgacggtgcatgccaaccttatatcggattgaagctgggtgccaactataccaaaatgtccagtgacttttacatttacgaagtgaaagacaacacttggggtttctatgtatcaccagaagtcggtgtgaatatctacccctggacaaacagtatcggcttccatctggcagcattctacagctactctaccaacaagggaaccgtatttaactatgatatggataaattaaacaatttcggtttccgccttggtgtggcattctaaagatttctaaactattctgttaaatagggggattatccgtgcgccaggcaggggtaatcctctttttttaattaataaaattaaattctgacgggagtgttaatataatagttacttttgtatgatatttattcagctaatacaaaaaatgtatggagaaatccgatagtattattattatacccacctataacgaaaaggaaaatatagagaacattatccgggctgtattcggactggaaaagttcttccacatattgattattgaagataactcaccagacggcacggcaaccattgtccgtaaactgcaaacagaattccccgaccgtcttttcatgattgagcgtaaaggtaaattaggactgggtactgcttacattgccggattcaaatgggcgatagagcatcaatatgattttgtatttgaaatggatgctgacttcagtcataatccgaatgacctgccaaggctgtataacaaatgtgccgttgaaggctatgatgtagctatcggttcacgctatgtcagtggtgtgaatgtagtgaactggccgatggggcgtgtgctgatgtcctacttcgcctccaaatatgtacggattatcacagggttacccatacatgatactaccgccggatttaaatgctatcgccgtgaagtcttggaaacaatcggtctggatggcatccgttttaaagggtacgcattccagattgaaatgaagttcactgcttacaagtgcggattcaagatagccgaagttcctgtgatttttgtcaatcgcgaattaggtacttcaaaaatgaacggaagtatcttcggtgaagctgtattaggagtcattcaattaaaactgggtagctggttccgcaaatacccgcaaaagaaaacagtatgaaacgtacatggataaagaatgcacggattgtgaatgaaggcaagatttttcacggttcgatagtgattgagaatgaagtcatagctgaagtgctggcagaagaaacagttccctcccagccttgtggagaaataatagatgcgaaaggctattatctgatgccgggagtaatagacgatcatgtacacttccgtgacccgggactgactcataaagccgacatacatactgaaagcacagcggcggcggcaggtggcgtcaccagttttatggacatgcccaacaccactccgcaaactacgaccctggaagctttgaatgccaagtttgcggatgcggcaaccaaaagcatcgtaaactattcattctatttcggagcaaccaatacgaatgcggatgtactccccacactagataaaagccgggtatgcggtgttaaattatttatgggagccagcacgggaaatatgttggtagaccgcatggaagtacttagaaaagtatttgccaatgcaggtatgctgattgcagcacattgtgaagaacaatctataatcagtgccaatacaacagccttcaaagaaaaatatggagaagatcctgatataaaatatcatccgcagatacgtagtgcggaagcatgtgcatattcttcctcactggccatccggctggcaaaagaaaacaatgcccgcctgcacatcctgcacatcagcaccgcacaagaactggatttgcttgaagacaaacccctgagtgaaaaaaagattacggcggaagcttgcgtgtcacatctatacttctatgacaaagattatgagacattgaaaggacgtatcaagtgcaatccgtccatcaaaacttcagaagaccggaatgctttacgcaaagcattgtctaccaatctgatagatgtaataggtaccgaccatgcccctcacttactgaaagaaaaggaagggggagcattgaaagccgtatcgggtatgccgatgatacagttttcattagtagctatcatggaattagtacgcgaaggcatattaagcatagagcaactggttcagaaaatgtgccatgcaccggccgaactttatcatattgaaagacgaggctacatccgtcctggttatcaagccgacctcgtattggtaaatccggatcatgaatggactgtaactgccgactgcgttttaagcaaatgcggatggactccgatggaaggacagaaattccacacacgggtagaaaaaacattcgtcaatggtgatctggtttacagtgacaacaaggtagaccaaagtcatcgcggacaagaattaaggtttaaaagatgattgtaaattacaagattcacgaagtaagcgaatacattaactggatttattttttccatgcatggggctttcaacccaagtttgccgccattgcggacatacatggatgtgattcatgccgggccatgtggctcaccggttttgcggaagaagaccgtccgaaagccagtgaagccatgcagcttttcaaagaggcaaatcggatgttgaatgaactggatacagcgtatcagacccacggagtggtcaatatcatggatgccaatgccgacggagatgatctgctgctgaacagcaagcgttttccgcttttgcgtcaacaaacagcaaaattgaaagaagatgacccgtttttatgtctgagtgactttgtgcgtccattatcatcgggtatcacagacaaaataggagcattcgccactacggtagatgcagaaatggagcggctctatgcagaagacgattacaaacgtatgttagtgcaaacattgtccgacagactggcggaagctactgccgaaaaactacacgaagatgtacgcaaaaaactttggggatatgcacctgatgaaaacctaagcgtaaaagacctgcataatgaaaaatatcaagggatacgtcctgccgtaggttatccttccttgcccgaccaatccgtcaatttcctattagacgagttgctggatatgaagcaaataggaatttcattgaccgagaatggtatgatgaagccccatgcctctgtatgcggactcatgtttgcccatccggcttcccgctatttctccatcggaaaaataggtgaagaccaattggcagattacgccgcccgccggggcatgagtatagaagaaactaaaaagtttctcgccgccaatctataaaaaacgaataaattatgatgctgataaagttatttctgttttttctactgctactgatattgcccgatatgtatatatacaaggcatatatacgccgtgtttcccaaaaatggacacattgggcttattggcttcccagtctgtttcttttattgggaatgacattagtcttttctatacatgagccacgtccggattccatgcagcgacttagcaatttcttattgatttttctttgtttctccgtacccaaggcacttttcgtcattgttatcctgtttatgaagctcctatatatcatctccggcaaaaaactgtatggaggatatgtagcaggaggattggctttagcctcgttaatatatgtaatatatggagcaaccgaaggaaaacagcattttcaaatcagggaggtaaccatcagttccgatgaacttcccagcggctttgacggctaccgcattgtacaaatatctgatatccattccggcagctggactggcaacggtgctgctttacagaaggctgtaaaccttattaatgcacaacatgccgacctggtactttttacaggtgacctggtcaataacgtggcaacggaattggacgaatttatccctattctagaacagataaaaggaaaagacggagtgtattccgttttaggcaaccatgactattccccttatataaaatgggaaacggaagaagctcaagaagccaacttgaacagcttgaaatccaaacaggctgccatgggatggaaaatactcaataacgatcatgtcattctacatcatcatggagacagtatagccctggcaggtgtagagaacagcggaaatcccccatttcccaattatggagatctgcagaaagcattaaaaggaacggaaggaatgtataaaatattaatgagccatgaccccactcattggcacagagaagtcttgccggaaagtgatgtacagctaatgctttcaggccacacccatgaaatgcagttcagcctgtttggcttctctcctgctaaattcgtatatcccgaacacaacggtttataccaggaaggaaaacaatccttgtttgtcaatattggtttgggctacctgatgttccctatgcgccttggagcatggccggaaattacagtaatcacgttacataaaatataaaatagtttttctatctttgtacaactaaaattcagacaaatgaaagtactatatattttataccaactattcatagcacttcccattttgctggtattaaccatacttacagcaatagttaccattattggttcatggataggcaatccgcatttttggggatattatccgggaaaaatatggtcacagcttttctgctatgtattacttattcctgtcaaggtagtaggacatccggaagtacttaaaaaaacatcctacgtgtttgtagccaatcatcaagggtctttcgatatcttcctgatttatggttttctgggacgaaactttaaatggatgatgaaaaaaagtctgcgcaaaatgcctttcgtcggcaaagcctgtgaagctgccggacatatattcgttgataaatccggtcccaagaaggtaatagaaaccatagaacatgcccgtcacgtactacaggatggaacttctctagtggtatttcccgaaggtgcacgtacttttaccgggcacatgggatattttaagaaaggtgctttccaactggcagatgatttgcaacttcccgtagtaccactcactattatcggctcctttaatattcttccccgtaccggcggttttgtatcctggcatcctatgaaattagtcgtacataagcccatttatccgcaaagccagggaatggaaaacatcaaagcaaccatggaagaggcttacagggaaattgagaaagacttacctgaaaaatatcaaggaaaaatagacaatccagaccaagacagataaaaaaggctcctcattaatggggaacttttaatttttccatattcgaacgggctactgtcacataatcctttaccaaggagttgtttttaaatcggtcaggagcctcctctataatttcctcaatcaagggagtcatgacaggataaggaaaattgctgcacaacataatgaaaacacccggtcccaatacattatcataattcttctggataaactccttagccaatgcattcatttcagcagccagtttctcacgttctctcgttatctcacgttgaatttcatccggtgcttttccatccataatcatacggctctcctgacgctccaactcgtatgccctgtcatccaaagaagtcttttttcccacaaaatcatacagacgatcattcaacggagttccggtaactacaatacgggcattatcaatactgatggatattttccctttttcaatgacaaaaggcatgatgctctcatcatccatatacaaggatgccattgaagtagaatcggttataccttccatcttgaacattccatgaattacctctgccgaatcaatactcagcatccggtctccactaggaacttttacaaatagcattttcccatccagacgagaaacagaagaactaccttctatcttatactcactggcacatgaagtaaaagccaataaagataccacagagaaaaaaagtttattcatgcttatctacgccccattactatttttcgcatacaaaggtacaatctataatttagtgacaaaaatattttattaaaatttaaaactaaatagaagattattaccgagaaggcaatttatagtgcaaagttccctctttttttctatttttgtaaccgatataaggataaagaaataacaattagtacacaacatgaaaaaattcaaacttttattgctcgcattgatgtgtgtagcattcttgccgtcgaaggcagacgaaggtatgtggctgttgcaactgatgcaagagcagcatttggcagaccgcatgaaagcacaaggcttactgctggaagcagacgacatttataacccgaaccgcgtttcattaaaagatgcagtaggcattttcggaggaggatgtaccggtgaaatcatctcaccggacggactgatcctgaccaaccaccactgtggctacggagcgatacagcaacatagctcggtagaacatgactacctgactgacggtttttgggcaaaaagccgcaaagaagagctaccgactccgggattgaagttcaaatttgtagaacgcattgtcgatgtcacagataaagtaaacaataaagtaaaatcaggcgaagtaaaagaagaggaaacctttgaatacgacttcctgaaaaaactggccgacgaggaactgaaagccagtgacctgaacggaaaagcgggtatcagcgcacaagctctgcctttctatgcaggcaataaattctatctgatttatctgaaaacctacagcgacgtacgcatggttgccgctccgccttcatccatcggtaaattcggtggtgaaacagacaactggatgtggccccgccatacttgcgacttttccgtcttccgcatttatgcggatgccaacggcgaaccggcagaatataatgaaaacaatgttcctctgaaagccaaaaagcatctggctatctcactgaaaggtattaacgagggtgactatgccatgattatgggattccccggaagcaccaaccgctatctgactcaaagtgaagtgaaacaacggatgcattccaccaacgaaccccgtatccgcatacgtggtgtgcgtcaggatgtactgaagaaagaaatggctgccagtgacaaagtacgtatccaatacgccagcaaatatgcaggttccagcaactattggaaaaactctatcggcatgaataaagccattatcgacaataaggtattggaaacaaaagcagaacaggaagccaagttcgcagcatttgctaaagccaaaggcaacactgattatgaaaaagtagtcagcgaaattgatgccgccatcgaaaagagtaatcctattctttataactacacctgtttccgtgaagtctttcaaggaggtatagaattcggcactccttatctgattctggacaagctgaaagacgcaatcaaaaataaagataaagaagcgattaataaaaatattgaaacgctgaaaaaagtatatgccgatatacataacaaagactacgatcacgaagtagaccgcaaagtggccaaagctctgttgcccctgtatgccgaaatggttcctgccaatgctttacctgccttctatactaccatccagaaggattttaaaggtaactatgacgcatacgtagaccattgttatgacaattccatcttctccaacgaagcgaatttcaataaattcatcaagaaacctaccgtgaaagccatagaaaaagatcctatgactgcatacgtacgggctaaatatgacttgatggacaagctgggaaacgaactggctgaatcgatgaaaggcatggatttattacacaaaacttatgtacgcggtctgtgtgaaatgtattcaccggaacccaaagctccggatgccaacttcaccatccgtctgacatacggcaatgtgaaatcatacaatcccaaagacggcgtacactataaatactacactacgctgaaaggtgtcatggaaaaagaggatcctaccaatccggaatttgttgttcccgccaaactgaaagaattgtatgaaacaaaagatttcggacgttatgcattgcccaacggtgatatgcctgcttgtttcctgactaccaatgatattaccggcggtaattcaggttctcccgtcatcaacggtaacggcgaactcatcggtgccgcttttgacggcaactgggaatcactgagtggtgacattaatttcgacaacaacttacagcgttgtatcgcagtggatatacgttatgtattattcatcatcgacaaattgggcggatgcaaacacctgattgacgaaatgactattgttgaataatgaaaaagatactattactctcgctatttactttcacaacccttgccggccatgccgacgaggggatgtggatgctgactgatctgaaagaacagaatgcagccaccatgtatgatatgggactggatatcagcattgataaagtatattgtccggacagcatcagcctgaaagatgctgtagtgcatttcggaggtggttgtaccggtgaaatcatttctgccgaaggtcttgtgctgaccaatcatcattgcggttacagctatatccagcaacacagttcggtagaacacgactatctgactgacggcttctgggctatgagccgcaaagaagaacttccctgcaaggggctgactgtcaccttcatagacagaattctggacgtcactccttatgtaaaggaacaactggccaaagatgaggacccggaaggactgaactacctgtccccctcctatctgagcaaagtagccaaacgttttgccgaacaagaaaatatagagatcactccgttcaccgctttggaactaaagcctttctacggagccaaccgctattacttgtttataaagaccatctataaagacgtccgtatggtaggcgctcctccttcctccatcggaaagttcggagctgacaccgataactggatgtggccccgtcactgtggcgatttctccatgttccgcatttatgcaacacccgacggtaaacctgctgactataacgaaagcaatgtacccttgaaggtgaaaaaacatctgaccatcaacctgggaggagtcaaagagggagacttcactttcgtaatgggatttcccggacgcaactggcgatacatgatttcggacgaagtggaagaacgtatgcagactaccaacttcatgcgtaagaccgtccgcaccgtacaattgaataatctgctggaagagatgctgaaaagtgataaagtacgcatccagtatgccagcaaatacgcctcgtcagccaattactggaagaatgctatcggtatgaacgaaggactggttcagctgaaagtacttgatacgaaaaagaaacaacaggaaaagcttctggcttacggacgtgagacgggtactgacgcctaccagaaagccttcgatgctatccgggaaatcgtgagcaaacgccgggatgccgtatatcatcagcaagccatttacgaagtttgcaaactgggaacggaattctataagattccttccacagacaaagtcctgcaagcattggaaaaaggatataaagtacctcatgctactaaagaaatcaatccgctggatcatgcattaagcacactgatcaaacaagccgataattttttcaataaagactataatcccgaaatagaccgtaaagtttccaaagctttgctgaagacttacgcagaattaattccggccgaacagcgcatcagcatctttaaagtaatagacaaagaattcaaaggaaacattgacgcctttgtcgatgcttgttttgatacatccatcttccgaagccgtgaagcctttgacaactttgtggcaaagccggatgccaagacattggaaaatgacctgatggtgcaatatgccaaatcagtagaccaaggttatgcagataccgatgcagccatgaaagccgaaaccgatgcttataatctggcccataaaacctgggtagagggtatgatgaagctgaaacagcatgaaggcactcctatttatccggatgccaactccacgttacgtctcacttatggtaaagtaggttcatacagccccaaagacggtatggaatacaactattacaccacgttgaaaggagtgatggaaaaagaggatccgaacaactatgaattcgtggttccggccaaactgaaggacttgtataacaagaaagacttcgggcgctatgccatgaaaaatggtgaaatgcccatctgttttgttacaggaacagacaatacaggaggtaattccggctcccccgttttcaataacaaaggggaattgatcggtaccggctttgaccgcaactacgaaggactgaccggtgacattgcttacaatccccagttacaacgtgcagcctgtgtggatatccgctataccttatttattattgataagtttgcaggagcgaaacacttggtagatgaaatgaccattgtggaataacaataccggacaactattttttagaacgcggaccacacgtaacaagtgtcgtccgcgttctcctatttttcacaagataagcctctataaacgcggacaaaaaatgacactggttccttaacgtttttccttctccaactcctgcggaatacggaaagccgtataaagttccaggacagcggcaatggaaagacaaacaatccattcgttacgtttcatggtaaacatcaatactcctgtaaagaccagtgcgacagccccgaaaatctgctgtctacgcaaacgcttgatgataaaattccttccatcataacgattccccatgacctgcacatagccgaacatcacagcacccagcgtatacagataaggcgcaagctcccaccgggtgatttgcaacaccgcacctgccagcagcaggactgcccctgccatcgaaattatattataagatttactcattcttcaaacacaaaaatatcctcgtcaggcttcttcatcaaaaacttctcgcgtgctattttctccaaagcctcaggattcgtggtcagttccttcagtttctccgtatcttcctcatattgctttctatatttctctatctcactattcagcgcgctgatctcactgcgatgctttacccgctgaatcaagctgttctcatccagaaaaccaataactacaataaagatcagcaccgtaatcatatacttatggcgccggatgtagttccaaatagtcagcaatttgctcatacaaagaatcccttttttgatttttgcaaagatagaaaatttcaagcaatcctacccataaaaacggataatttatgtacttttgcagaactcatattagaaaaaagaactccgcttatggaaaattatatcgtatcggcacgaaaataccgtcccgctacattcgaatcggttgtagggcaacacgcgttgaccatcaccttaaaaaatgctattgccaccggcaagctggcacatgcctacctgttctgcggaccgcgtggagtgggaaaaacaacgtgtgcacgtatctttgccaagaccatcaactgccagacccccactgccgaaggagaagcctgcaatcagtgtgagtcttgtctggcattcaacgaacagcgttcttacaacatacatgagctggatgccgccagcaacaactcggtagaagatatccgttcgctgattgagcaggtacgtatcccgccacaaatcggcaagtacaaggtatatatcattgatgaggtccatatgttgtcgcaagccgccttcaatgcttttctgaaaacattggaagaaccgcctcatcatgccatcttcatccttgccacaacggaaaagcataagatactgccgactattctgagccgttgccagatttatgactttaaccgcatcggcatcaaagacactatcgaccatctgcaatacgttgccaaactggaacatatcaacgccgaacccgaagccctgactgtcatcgcacagaaagccgacggtggtatgcgcgacgctctttccatcttcgaccaggtagtcagcttcacaggtgggaacatcacttacaaaagtgtgattgaaaacctgaatgtcttggattacgaatattatttcaagctgaccgatttgttgcttgaaaacaaagttcccgaatccatgctgctttttaacgacgtattgaaaaaaggatttgacggcagtcatttcatcaccggactatcctctcatttccgggatttgctggtgagcaaggacccttccaccctgcaattgctggaagtaggcgccggtatccgcgaccgctataaagaacaagcacaaaaatgcgaccagaaattcctgtaccgtgccatgaagctatgcaatgattgtgacctgaactatcgtgcaagcaaaaacaaacgtctgctggtagaactgacactgattcaatgcgcccaactcactctgcccgatgccgacgatgcaagtggtgggcgtggccctaagaagatattaaaacccctatttacgcagcaagcggcttccacagacgccacgcagtcacagcctcaggctaaaactgccgctgcacagaccgcagcaaccgccgctcctcagccacagggtacaagtacagccggcagtatgaacgcaagccgtccaagcccgctgcctcagaccagagaagagaaaaaaatcccggtgttcaaggcgggctcactcggtatatccctgcgccgtcctttgcacgaacagcaagccgcggagaagcaagaagcaaaagcggcaagcaccgctgcccaaaacgatgccacatacgaagattatattttcaatgaaaaagatctggactattactggcgtgaatttgcagccgccctgcccaaggaagagaaggctaactccgcacgaatgatgaacatgcatccgcatttgttgaatgacacgacttttgaagtgacagtagacaatgatatggtggaaaaatatatggtacaattgataccatcggttcagaatcacttacgcgaacgtctgcacaaccggaaaatcaccatgacggtacgtgtcagtgcccctaccgagaacatccgtgcttacagccacgtggaacgtttccagatgatgagcaagaaaaacccgaatctgctgaaattaaaagaagcactgggattggagttatcataaaacctatttaaataaaaaaacaccgggaaatccttcaaatccttcatatttacacaatacattgtttttcaatgtgttgtcgtgaaggattttgaaagggatccttcataaatgattcattgagcgtaagcgtctccgcgattctatcttgtcgcccttttttcattcttatatttttgccatgtataaaaatgaatcattatggatttagcagaaaatcgatttggaaaaacttggaaagacggaaatactgtggattttctttggaatacatacggcaaatgccatactgatgatagaaaaaatcagaaacaaaacagctaaagcagcatgatatgattttactcacagaatcagaagaggtcatcagacttcttccggaacgtcatgtcctgtcggatagaagtatgtgagaaagcacggaaaaatgacaataagaatggcatatgaaatggtcatgccctatcatcttcatatgccatcttattttttagagacatttactgaatatccctacaaaactttcaagaaaaattctgcccacctcctttaagagaaaatttatgtgttagagggaattatcaatagttcttcgtacaaagtgaattaaagtcagtttcaattttaggtatctcccacacccaaccttgtgcatctttatccttttcaagaaaagtacagaaagctatatcaaaatttgatccacgcttaatagacatatgcaaacgtttcaaatcataaaaacgaaaaccttcaccccacaattccacccggcgactattcataatttcctctgccaaagcatcaccgatatttccttttgaaacataagagggatcgcgggttatctggaatttagtaaacacagcctgcgcctcactatcttttcctgcacgagccaatgcttcggcctgggtgagatacatttctgccaaacgcataaatgcgacatcacctacagcatcggctgtagaacgggcagtaaacttacggttttgataagcattctttgcataacttgatgatggaacagatgcttcccctgtcggatcccaccacgcacgccgtaagtctgtttcagacatcgtttcataagcatccacatttatgcacttcactccctgacgaatggcactggagttaaagttccatgacatatatgcataataagaataaaaatagacagtcttatcatcgggagtcattgcagcatacatcgcttctttagtgtccgtcgtgatattggcaaacccacaattcaactgactgccagtcatcaaccggtgaccaccagcttcagctaaagaaacagacttccctgcataaaccgccgcattattataatcttgcatggccagtgctacacgtgccttcaatccccatgccaccatctcgctataatgattgacatcatttacttttattccactcaaaagtatacaagcctcatccaaatcattattgattttagcataaacatcttctacggaattacgtgcctgctcttcggccacagctttttcacgataaggaattccatcctgtgtattatccttgccggcttcataacgttttgcataaagctggaccaaattaaaatgagcccaagcacggatacataaggcttctccctttatctggtcaaacaattcctggctagttatttcaacttcctccaaacccgccaaaattttattggcattcagaatccattgataataaatctgccagaacttataattataaccattcgtttcattcatattgcattgccatcctaaataggccgccttcatccatgtatttgtctgccaattcatatcatcagcctctgcatcacgtgacatcataaaaccgggttcaccgcccagacactgatatccgctttcctgagaaaccatctctttatgaattccgttcaatgctatataaagattgtccaacgaggtgtttattgtcgtttctgaaacagaggtagacggaatggtatccagataatcaccggcacaaccggatagagacattactcccactgtcgctaatcctaatgttatatttttaattgatcgcataattcttttatttttagaatgaaacattaagccctaacgtgatattacgggacggcatatactcattataagtcacaccggaatagttggccatcgggttcaatccctgacgggctttcaacatgaacaagttttccgcagtcagattcaaacgggcactcttaagcatcactttgctcaaccaagtttttgggagctgatagccaatagtgacagatcttaaattaagataatccgagctggtaagccaacgagttgaataagactgaccaatattcgtggtatgagccgcactattgtctatacggggaacctcagtaatatcccctgcctgtttccatgcttttaacaaatccggactttgtgcataaccaaattcagtcatactcatcatggtagcataattagtatccagaatctgaccgcccaactggtaagagaatacagcagccaattcaaagttcttataactaactctgacattaaacccaccatacacatcaggaatagaagaaccgctgaagtcgtatttagcataagtatacgaattggtcaattccttaccatcaatagtcactactgtttttttatactcatcaaactggctctgcgtaatgtttccatcccctgttccgatattcccttgattatatttacttacatcagccacatataaaccatcaccggtctgagggtctaccccatgccattgacgaagccagaattcataaatggactttccttccaaccacttttttgagccactgatatatccattttctttcattgtagccggcagattcttgatcttattcttcacaaaagtagcattggccccaacagatacactccaatctttatttttaaatgcattataatccaactctatttccactcctgaattagtaaccttaccgatattctgtataatggatgttactccgacagaagcaggctgggaaacatcaaacaacaaatccttggaatctttcttaaaatattcaatagtacccgtcaaacggtcaaacaaaccaaattcaagagcaatatccgtagatatctgtgtttcccatttcaatgagggattggctatcaccgtgaagtaggctccagcttctgagccattcttatatcccaaaccatataaggtctgataaggataataatcaggatcaccatcactatccaatatattatcattacctgtttcaccgtaagaagcacgtaatttcaagttattcacccatttcacatccttcataaatgcctcttcactaattctccagcctgctccgaacgaccagaaattcccccatcggttctcttttgcaaaacgcgaggaaccatcatggcgataagaaagtgaagcgtagtatttatgcgcataatcataattgatacggccaaagtaaccttcctttttataggtgttcgtataggagctaagtgaactgatatttacgaaattaccaaattcatacatgcccgaaactgtttcctgggtcttcatgccatataaatactcatacttataagaatagttttcatgtcccaaaagaacgtcaaagttatgatttccgatagacttgctataagttatcaattgattgaaggtctgagtcagcgttcgggtagacatttggttcaaacgacccggtccggcagtgccatcgcccacataaggattttcatagactttacgacgataatcaatattattgatagagtaattggctgtaaggttcaacccttcaaccggagtcaaagtgagataagtatgtccagtctgattaacacgcaccagttcacgttgattgaactctgtttcagctatcgcatcacgtccattattcgacaagcgagttccttcataatcataaatatattcacccagatcagtagttgccttaccattagcatccaaataagcaccggtttccaaatcatgtttatgaacgggatatataggagccatggtacgaataaaacgggtaaggttactatatgaactcgaatttcccgaatctgaagttgaataattggataccgtacgcgttactcccaaattcaaaccagtcttgaaccatttagtaggatacacattataattcaaacgaccagaataacgttcaaagtcagtcttgatcatataaccatcatcatttaaatagccaacagaagcataagtatcacttttttctgtttttgtattataactcaaattatattcctgacgatagccggtcttgaaagctgcatcttcccaatccaaatcatccccccacttcaatgcatcagcagaagaattcagttttccatcagttccgacaatggcatcatctgcgacaccaacaaaaggattatacttcaatgtacttccaattttagatgttgccaatgaggccgccgttgcagcatccttaccagatgtaatataagagttcttcaacatctcccattgtaaaggatagtaatcataaatccccacctttttataatctttataagccctgtttgaccatccttggttaatggtcaagtttactcctgttccacctgactctttaccttttttagtagtaatcaagatcacaccattacccgcacttgaaccatacaaagaagtagatgccgcatctttcaatatagtcatagactcaatatccgcaggattaatatcacctatgctgccattgtatatagttccgtccactacatataaaggagcattggatgcattgactgagccaaacccacgaatacggatagaagaagattcaccaggttgtccggtggcagcagtcacctgaactccggaagcatttccttccaatgcagctgtaacattagtgatagcacgtttctctatggatttggcccctactgtggaagcagctcctgtaaaagatgattttttctgtgtaccataagccactacaacgacctcatcaatcaattccgtatcactttgcatcactactctttgctcaccaccctttatagccaattcttgtgttttcataccgacaaacgatattaccaaagattttgcattgaccggaatattgtttatactataccggccattcatatcggtaatagttccaagggtagtacctttcacaagaaccgaagctccgacaatcggctcattgtcttctgccgaaactacaactccagtaattcgggatacttgagccattgccatacctgtccataggaatagacaagccaacgtaaacaaaactctctttttcataaaaaaactttttaatttaacgttcataaatgctaagttctcttagaacttagataaaaacgctcaaaaagagttgttttgctggatttggcaagcaaaaagtaaggcttaatagaataaaattatttattatccaacattttatctgcaatttctttgatatttaatatattttcatatctttgcagcaatatttaatataaagttctaagagaacttaggtcatgttaataattgaattatagggaattaataagactcaaaacatattgtaacgcttttacatacctcacatattctcagacaaaatgaagttccttggggggagttacaatttacctttgtctacaatcagcaagggccacgccgaaattcgacgaagcccattcctaaaatactccatttacccatccttactccccaaagacaagtacaatatttattcttctatcaactcatactttccttccgggaaccagcgttccaatatattatccacttctgattcaatctcaggagtcacatagcggcacacctttttataagcataaaccaaagataccgcttcatcaatccagccgataattggtaaccgcttagccgaaatcaaatcgatcggcaataccagatacgaaagtgccgccacaatcaacatcttatccgaagagggagtttcggggcttcgcaatacataatataatagaagtacaggacgagcagtcgttctaccggtggcctttgcgtaatccgtaattttctcccacaggagttcataatcaatcaagttttttttcattttcatatatgattttgttaagggtaatatatctattattccggtaaatttatgaacttaacttcgtaagccaagcaacttatgttcgtgagtcaagttacttaacttacttgccccatgaacttaagttcattcaaatgattatcttgtttattttccggtactcatcactccggaatcgttatcactattattcaccctccgttgacctgtcttaaacttacggccaaacgagaaattataagaaacacttgccaaaaacatttgcgagctctccttcacataattcgtttttttataagaagcatatttattccagttctcagtctgttgcttataattatccgtaaacggattgaaagcgcccaaccccacacgcaaattcttatgcgtgtaatacatcaccaatacctgaatattctctccccccgacaaggtttccccccagaaattattccagttagtattcatctgccagtaaagagagaactgcttgtaattaaaggatgcttcagcattacaataccagtttgtataagtatgagaatatgtattaccatgactcatataatggtttactccaccggtaaacgagaactgtagcatatccttaataggaccgacacgcaaagtcagacgccccgataatttctgccaatccttttgattgtcccatgtctgtacaatcttgtcaccgtcctgatacttctcgtccataatggcattcggctgataatcatacgctccccaaagattagaataaaatatacctttctgccattcgtatgtcaactctgtgtgataacgcaaataggctttcaagttcggattgcctcgtctgatttgcaacgaatccacaatctgttctacagcacttaaatcccccaatgacggcgaagcattactgatatcggatttccaacgaacaaatgaatttcccggtaatgcataatgcagtaccaaacggggattaaaactataattctcatacgaatcatcaccactttgtttataataagaacgagtaacgcctacccccaatctgtagtccaattttttcacctttcctctatattcaccataaacatatgtatccccttgattcatatccgtttcataataatgaccgttacggtattcattattggcaaaagactgagtatggcgcaaaccgaaactcaaggaatttcctttagaaaattgcttctcataaacagcctccccaatcagagaatatttatctcccaatacattattattaatatcagtcaacaactcatcctgcaaactttcttgatacaaacggcgtgatttttccttattataagtaccgaccacattgaataccaaaagttgcttatttttcaatccctgttgataataaagatccaacgaaggacgagaccaactttctttagtacggtctatcatatccaccttatcatcagaatcggcaatattagtcaatactccttgataattccaatgcggctggctattacttctcaaacgaaaagtagcactgaacaatgaattttcggtctgctgcaaattataattcatacttaaattattcataaacatagatccgtgccccggttcaccttcttctatacgatgtaatgtcgttccgtccgccaaatggaattcctcttcattatcccggtacataccatagaaatcgcgaggtcccatgtaatacgaaacgccaaactccgacttcttatggttcacttttccaaaaacattatattctccccacatggcattcatcccctgagacaaatccactccaaagtttccccccgtttccggacggcggacaatataatcaagcactacctcagcattaccataacgcaaacctggattgtcatgatactctattcgaataatgtctgatggctgtaatgccttaatctcttcaacttctgctttcgctccattaatacgaagctgaagttctcctccccctaacactcctatctcattattcatggggtttatctgaatacggggaagcatcatctgttgcaacagattgactccatttgtcgaaaccttcatttgccgttcagaaggaaaaatcaacttacgatccgaatgactgatctgtccggaagcactaactgttacaccttccatagccacagcatcatcttccaacaaaatttcccctaaatttatattctgtttaattccgtctaatacaatgaattgcgtacgataccccacacaggatagtgccaataaataattgcctgcataaaccttattcagcaagaaatcgcctttaccattcgtagtagtccctccaacaaaaaccgaatctgctgtttgtaaaactacattaacatattctgctgcctttttgcttgtcgcgtctttcacagtgccctttataattatttgttgggcaaaaactccttgtaccatactgactaccagtatagctatcattactatttttctcattttaaatattatgattttattctttttacaagatggcctgtcctgcttaaaagttattgttttactgtttagacgctagaagctgaaaaaaagttgcacttccctaaactttttgcttaaaaaaaggttatatttgcagaaaacctgtttcaataatgaaaaaaattcttctaacattagcacttgccttttgttgtgctgcagggcaaggacaaactacagccaaaccggcagatgtcaatattcaagagttaaatacaaagtgggcaaaattcactcagtatgccgaacaaaagcaaataaataaagcggtagaagagggaatacggataagtacgctctttactcaaaacaggcaatataaagaagcctttgccacttgccgacaaatggatgcattgatttattataatgagcaagaaaaaaaatcacccgaatacaaattacgtttcatggtgggtaaagaacgcctgcgtatgtatacgaatctaaaaaatacagaacaatgcaagatactattgaaacaacttcattcctatacagaccaattaaaatcagactctttacaagaagagcttctaatgacggaagccaattattatcaaactttcggtatgacagacaaaagcttggaatgttacaacatcttattccaaaagcgctctgccggtaaagacgaaaaaggaatagaccaatgctataaagacatgttgggatatgccgaacagaataataatgccccattggctattgcaatgagaaaactttatacttcatggcaagattccataaaagcagtaaaaacagccaatgaactaaacacactgcaacaaaaatatgaaaccagccaaaagactttgcaggaaaaagaagacaagattaccacaaatctaattattatcattgcactatgtgtgttatccgccatattggctgccggattattattcttagctaccctgttatttaaacatatccgccaagtaaagaaattaaaacatagcctgcagatagcgaatgaaaacaatgagcagaagtctaaatttatcggtaatatcagcgcccaaattgaaccaagtctgaatacaatagatgaagcaacaaaggaaacaatatccaccccaatattacatgaaaacatcaaggcactgaaagaattaatgacagctatccaaacgtatatttcattggaagaaacacgtgaagaacattatccgctaaaggaactgaacataaatacattgtgtgaaagtattatggaaaaagcgaaaataaacttcaaatccggagtagaagcagtggtaaatgttccacgtgtaaatattaagacaaatgcagaagaattggaacgtatattaaaccatttattgaacaatgcggcagaatatacgaaaagtggtaagatttcactggaattcaaaaaacgaagcgcccatacacatcaattcatactaaccgatacgggaacgggaattccggttgaagcacgtgaaaaactgttcaagccatttgcagaaatacgcgatttaacgcaaggaaacggactagggttgcctacttgcagccttatcgcttataaattaaatggtacactgactttggacactgattataaaaaaggaactcggtttatactggaacttcatgtataatagtgtacattctcacatattaacacggattattcattttgacaatcaataaatttgatgtaatccatgttaatatgtgatgattcctgtacctctccgctagtgagattataaataattaatgagaagaaagagacaacacatccaatcctgaaggaatttggaatacccttaatccaaattcgggaagaacagccaacaaatggtcaaaaacctctgcttgcaaacgttcgtatggaatccagtctttattggctgagaagaaataaagttctatgggtaatccttgcggcgtaggttgtaattgacgcaccatcaaaatcaattctgtattcacccgaggattatgacgcaaataatattccatatagtgacgaaatacataaagattcacctcctcctttcctgtcttttcaaagcctgacatccagacttgtttttcaaattttttcatttgttccggtgtacagaaacggaccgtattcatatctatattaatagaacgtttcactctgcgtccaccactttccctcatgccacgccaattctgaaacgaatcactgaccaatgcataaggtgggactgtagttatagtattatcccaattgcgtacctttacagtggtaagagtcacttctattactgtaccgtccgctccgtatttcggcatggtaatccaatctcccggacggagcatatcattggcagaaagctggactccggctaccagccccataatcgtatctttgaaaaccaacatcaagatagctgcagaagcacccaatccggtaagaatattcacaggatctttatcaatcaaggtactgactataatgatcacccctacacaaatcacaatcagttttatcatctgatatacccctttcagaggatgattctttagtttctcatgttcgcttgaaatggtatagagagaagtcagaaaagaacaaatcaacttcatggctacagccgtgatatacacccaacatagcttcagaatgaatgtcaaagtcacaggttcatgcggaaaagcaaaaggaagcaatacatacaatataataggtggaataagatgacacatattatctaatacagcatcattgaataaataatcatcccaagtagcctgagtccttgccgtcagtttctttatagtaggaactactatttttctacaaaaataatctgccacaaaagcaatgatcagaatccctgctataatgacaatacgctgggttatacccaggctttccttatgcacacccatctgttgcaataagttagtaagatcgttgtttattgtatccatatttccatgtgtttgtcgcaaagatacacaaattcaccacagataacgcaaatccatacagtttttaaatcgagttgtccgtataaatctgaccaatctgtggtgaaaccaaacaattattttttcttagtcagccatttttcctgaatatgctgcatcacttcataccagttaggaatataaatggtagcaaaaattgtattcacagccataccgaacaccactgccgcacccagtgccacacggctgcctgcaccggctcctgtggcaaacaacaacggcatcacacccagcacgaaggtaaatgaagtcatcaggataggacgcaagcgcacatgccctgcctcgtatgccgcctcacggataggattgccggccttacggtaatcacgggcgaactccacaatcaagataccattcttcgcagacaaggctatcagcagaataataccgatctgggtatagatactcaccggaacccccatcacccagcagcccaacatcgctcccaaaatagcaaccggaagccccatcacggcagccactggacttgtccagctttcatactgtgccgccagtaccaaataggctaccaacaaggccatgattaaaataattgtagtagtattacctgcctgagtttcctgataggcaacagaggtccattcatatccaaactcaccacctagctgatttttaatcaaactccccatagcctctatcgcctgtccggaactactgcccgcagccggcgtacaagtgatggaagcagccgaatacatattataccggtttatctggtccatccccagtttttgttctatctgcgtaaaactgctgaaaggcaccatctctcccttcgaattgaccacactcagttttaacacatcatcaatcactttttgggcttgttcgccagcctccaatttcacttggtagatacggccgaattccacaaaatcatttacataagcctgccccatgtaataccctaatgtagaaaagacctgattcaactgcaaacccatcaactgaactttatcccggtctatattcaaaaaatattgaggtacatccgcttgatacatactgctcatggaagcgacagccggttcattatgataattagccaataaagcctcaaccgccttttgcagttcttccggacccaaagacttacgatcctccagttcgagttgtaaaccacccgtattgcccatacctggaatagcaggaggaataataccaaagacttgagcttcctgtatcatggcatatgcctgtccgttaaaacgattgaccaccgcttgagcggtatgctctttacccgcacgctctttccaattcttcagcaccacaaaataggtagccgcattaggcaactgaccacctcccatgatactgaatccgtttacgcccaaataagtcttcacttcgggatactctgacaaaatagcatcaatctgcttacccaccatctgtgtacgctctaaagaagaagctgccggaagctgaatggcaatcataaaatatccgtcatcttcttcaggaataaaggtgctgggccattttacaaacatcagaatagcaatgactgagattacgatataagaaccgatagcaatgaccggccgtgccaacaaccattttaccgaagcgtcataaacccgctgcatccagtcattcatcttgtcaaaccagaggaacaaacgcgctttatgcgtcggggtgggacggagcaacagagcgcagactgccggagtcaaggtcaatgagttgaaaccacttatcactgtagaagccgcgatggtcaaagcaaactgtttataaagctgcccggaaataccgctaatcagcgtagtaggaataaatacggcaagcagtaccagcaccactccgacaataggtccggtaatctcccccatagcctgctcggtagcggcacgggcgtccagcttcccttcatccagaatacgggtggcattttcagtcaccactatggcatcatccactacaatagctatagccaatatcaagccgaacagtgtcaatgtattgatggaaaagcctaaagcagccattaccgccaatgttccgataagggacacagggatagtaagacaggggataagaaccgcccgccagctttgcaggaaaaaaaagataaccagcaccaccagaataatcgcttccacaaaggtcttcatcacttcatcaatggagtcgtgtaccacatcggtagtatccaacgtcacattgtatttcaccccggccggaaatgtttcagccagttccgccatacgggcacggacgtgtttagaaacatccagcgaattacttcccggcaactggtaaacagcaatagcagccgtaggttgccctttcaagcgggaaacaactccatacccggcactgcccaactcaatttttgcaacatctttcagacggagcacttttccctggtcttccactctcaatatgatgtcgccgaactcttcgggagtagaaagacgtccttttacattcagcgtatattgaaaatcattatcggccgaactgccgatgggttgtcccacataaccggcagacacttccatattctgactttgaatggcagcataaacctgctgcggggtaatattgcggatacgcatggtttcaggattcagccatacgcgcatggaataatcaccggctcccatgacatccaccgctcctacccctggtacacgtgtcaactggtctaccagattcaaattggcataattggtcagataaaggccatcataaatactgtcaccactcagtgtaagcatcatcacaatattggatgactgcttctgcaccgtcactccctgtaccttcacagcttcgggtaaagaattcaatgctacactgacacggttttgtaccatcacagttgccatatcgatatccgttcccacttcgaaagtcactgtcagcgaataagcgcccgatgcagaggaattggaactcatatacaacattccgtccacaccgtttacctgctgttcaatggggataccgacagtttgagctacagtttcagcattggcacccggatataccgcactgacttgcacggtaggaggcgtaatatcgggatattgcgccacgggcaatatattcagggttacaagtccggccaccacgaataacaaagccagcaccgtggcaaatataggccgttctatgaaaaattttgaaaacataaggctattgaagtttattggtttgttctatcggtttaattttcatgccttgacgcactttcaacaatgccttggtgacataacgttcggaaggtgacaagccactttttacaacacgcatattatgatccgccaactgcccgacttcaatatgccgataattcactatatcactgtcattcactacatacaaatatttacccaactggtctgttccgatagaagcatcattaaccaacactgcattccgcgcttcaccgtatggtaaggtgacactgacaaataatccgggacgaagcatcccgtcagggttatccaattccgcacgcaaacggagagtacctgtagttaatgtcacattgggagaaagataatccagtttcgctttccatgactgtgccccgtcagttcccaaacgcaaggttacaaaatgagtttccgcaggaatcttgctggcagcctcctgggccagctcgtatgtcagatattggttatctgcaatattaaaataggaatacatacggttatccttataaacagtagccaatttaaccggttgcaaagcaccaccaatatacgccccgacagaataagccgaaacatcaaccactccgtcacaaggagccttgacatagcaataactcaagttggtacgcgcagttttcaaagctgcttcagcattacttacggcagcctcacaagccgccacatgactttccgcctgtaaatattgtatacggctcaccgcatcactttttatcgcttctttcatacgttgataactactgacagcatattcaagattggctttagccgtttttaattcagcttccgcttgtttcactgaattttcataaagtgtcggttctataacgaacaatacctgtccctgacgtacccgggaaccaggtgcaaaattcttggattgtaaagttccatttactcgtcccaccaaatctacagtagattccgcttccagataaccgggataatctttggtcagcgtcacattttccaccaaaggtttcgcaacatctacaggcaatgcctgcatttctgtctgagaaggtttatttttatcgcaggcggtcaacacacataccgtccatgcgaaagctatcattatttttttcatatcttgggttaggtttttattatttctatagttcaacagcttttccgtcgcagcctaccagcctcctcccaatgcctgatacatctggatcagacaaagcaatgaatatccctgtgcctgcaccaatgaattctcgtatgacagtaacgaacgctgtgcatccaatacattttggaaagggctcagcccctgtttgtataagtccaatgaaagtttaaatgcctctttcccctgattcaacatctcacgacatgctacaatctgtttgatggaattcttataactactcatggcattatccacctcctgcaccgctgtaagaaccgtagtattgaactgattgattgtttcatccagttgtgcacgctgcaagcgtacattattcgcacgctggccaccattaaaaatcgtccagctcatagagggagcgatactccatgtcatactgctacgtctagtaaaatctttcatatcatgtgaagcatagccgaaggaaccgttcagaaaaaatgagggaagccaatcggtcttggaagctcccaacaaggctgcttgtgcattgacttgacgttcggcaacccgtacatcgggacgtcgtaaaagtaattgtccgggaagaccgacccctaccggctctatataatcgggtaacggttttcccgtttccagtgcagccgtcacatcctgaggataaagcccgagcaatacagccaacgcattcatatattgaataataccggattctgtagcaggaatagaagccaatgtactataataaaccgatttagcctgagccacatccagtttggaagccagtccggtattataacgcacttcagttatatctaccaccgccttttgagataaagcattgcgctgtaacacactaagttcctgttgggcctcacgcaaattaaaataggctgacgccacttctgcacaaagacttaccatcgtcgcattgtactcttcacgacttgccgcaaaattttctttctgcgctttcacccgttggcggatggaaccgaacacatccacctgccagctcatattaaccgttgcatcataataccccactctggattgaggctgtcccgtaccggtattgccactagtctgttggcggttccacccggcatccaatgacaaagccggataatagcctcctctggctatcctcagattcgctttcgccatatctatacgattcaaggctgtaaggacagacggattctgcctgacagccacatgaatcaatgaatccagtgtggcatcctgaaatacagtccaccaatggtcatccaccggaagcagttgttgaaacatcgcatcctcttcttgccaatgttccggcaagggtacattcaataatttttcggcccgctgctgggcattcagtgccaaaggaatgattaaaaggagccatactccccatctacgtattttcctcataagtttatcacattaaaaaacattaggaaaacacatgaaacaacgttttgtttaaccctttgactttcaaaaacaagacagcctctccttctgagaagaaaaggctgcaccatacaatatgaaaaaagaagttatttcccaaacatattatttattaatgacatagaaccggtcagcatacttcccaagacatcctggttgaatgcaatggaatagtttccgggagataactgtatatccatttgtacgataccgtttttgccgattttcttcaattctttagcctttatattataataggcaaaacggcggaaactttgatacacatcactcatctccacatctacatgctgcaatacagaagcgccgcctgctaccgtaggcagctctaatgcctttccattatccaacgtcaggacacacttactgtcattaggaatttccacctcatgccccgacccgatagtaacagccagcgaataacgtatggtacttttatactgaaatccagcgagtgccacatatacgtccatattattggaaacacccagattcataccctcgcataccactgtacgcactccggtctggttggtttcatcataaattaccttttgtgccatagctcctatacccagaagcaaaaaggcgaataaaaacaatactttcttcataattcttcagttattatttcatcatacaacaaaaacaaactcataatgatgacaatattaacaaaaacttttcatacaacatatatcacaacgcatcatttatacgtttttatccgaacaagcatagaactataacctttcgcatctcttatttcaatctactctaccgattcgattccaacgaattgaattttgctcttcatcttttgaaaaccaaatccattgtactacacccacaatgaaatcatcaggcaccaatccccaatgtcgtgaatccaatgaatggtgtatattgtctcccagcataaaataataatcatgcttaaactgataatttgtgaaacgatgatttcctataaaatatgcgctatctttataatctattttctgtttagtctcccattccataacacttccatattgggtagcagtcaaactatttatcgggatttgatcacctttgcaaggtatataaagaggaccgaatttttcagcagtccatcctaacaggtcatagtaattatgatcaaaagaaaacgtaaggctatcctcgactaaggcagataatgtaggcaggataattgccacagtgtcacccggaagccccacacatcgtttagcataatattgcatgacatcaaaatgtattcgattcttatattgcccgactggtgaattaaaaatgagaatatcattttttcttatccgtcgtattcccggaatacgttttattgatatatgcttgttttttaccgcattaaaaacattaaatatcctgccgcctgctatccatttattcactattacatagtcaccttttatcagagtaggatgcatggatgcagtaggaatcctgaacgaagaaaaggtcgtgatttgtaacagcaaccatatcagagcaagtacacaaccataaaatacaaagtttattaaacggtctatccatttattcttttcttttaccctctggttcattcatcaccctccacctccggcttattattacaatcacgcaactgtcccatatacatctcttttatccgaggatgatgcataggatttcctactaatatcactttattagtattgtcaagcaagaatgtcctaaatttatcattcagtggaaacttattcagtttattaaaggtatctttcagatctatacatacaggataaataaaatcttctgactgtaatatcattattagttccttcctatttctagggtggaagaaaaaataaaaggatacattcctagatgtgacagagtctacctccgctataaaatttatccgttccaataattgcaatttgcaactaaggcatcctaatgagtctacataagttacaattttataatatgttgaagcataaggaaacttatctaatgtgtctttgccttgtatggtaaagacagctctatcatgaaagagaatttcttttcgagtccattctttcatcaaaaaagtcaactgctccttttctgtccttttacacgagaagaaacaaaataccccaaaagccaacaacacataaagcaggattttcataattttgctttcaggatatcatccatctcaaatatttcaacattacattccgattcgcaatttaacaagtacaactgaggggtatattgagaaagaagcacactcatgctttggtgttccaatgcgtacttgcctaccagttcaccatcgatggaaaaacccagcaaagttttaggtgtacaggctgaatagttttcaaaggctttatagcataactcaccactataagtcacaaaaacatatttatcattggctgtcaatccataaaatccatccaagttattcttctttcttgcaagatttgcttcatagacattgcaaacaggctcaacaagcattttttcccacttcaaagtaacatcttcctcatccgatatatcataccgacaaagataaccaaaaaatctagatgcaaaataaaagctgtttttgtatgaaaccatctccccctgcaactgcataaaatcatttgcttcagtagtcattccccgcaccggatgattaccgaaacgctttatttctttaaaatccctatcaaagagaatgaaaaactccttacccccagacaaagtcgtcgccacactataaccattggacagtcgacagaaacgggttgtaaaacaaccatcttttactttaattttttcacttcctacataacggtagtcagcacccttttcctcccgtgcatacaataggacagtagaaggcaaattaacaaaatataaagtatcgtccccctctgtttttccaataaattcagcggctataaattctccaggcccttgtcccctgcttccaaagctacccactctttcgcctgtctgttcctctagaatctgacaaataggttcaccaggaagtttacaacgttgaaccataagaattccacaatcaagagaagagaatgcaaccaactcattggacataatttctttatcataataagagccatagatcggtttggcgggaatagataaaaagtcatttcctttgttactgacacaggaaattaaaaaaaggatggtaacaatcgaataatacaattttattttaatcataattttaatactcttcaaacgggacaaaacaaatgcctaacacctatttattttgtcccgtattacataaatgcctaattactcaggaatggtatatcgatttacccaattcgcttcctcacttgtttcaataataacaggttcgcccggaggacctacaacgagttcataacaacgtgaattacgttgatacatacaatccttcgtacctaaagtcaaggcctccacatttgacaaagctaaatcggacaattcttctttgttttgagaaccatacaaaacataacttccaccaactgccaatgaggcaatcaatgccattttaaatgttcttttcataatatattttttaaagtttgaaatagggatatcttatgatgattcaaagaggtataatgaaaaagataccgtctgtccctatcatcagaaacagaccgtccacgaaggccatttagcttgattgtacttggaggtgaatgttttcatagtatcactttctacaaagaatataaaaagtttccacttaaacaaacatttccgcttttattctacaatataattatcataaaaacatttgtatcctcctcgattcatgctcacacctcacctttttgtgcatattttctcctcatatccttttgttgctcaaattgtttaagtaaatttgtcgccagaatattactaataccaaatatattaaagtatatgagtttaaaaattgtagtactggcaaaacaagttcccgacacacgcaatgtggggaaagatgccatgaacgctgacggtactatcaaccgtgcggcacttccggccatcttcaatccggaagacctgaacgccttggaacaggcactcagactgaaagacacacatcccggttctacggtaactatcctgaccatgggtcccggacgcgctgccgaaatcattcgtgaaggtttatacagaggagcagacaatggatatttattgaccgaccgtgcttttgccggtgctgacacgttggccacttcatacgccatcgctacggctatccacaaaataggcgaatgtgacctgattatcggtggccgtcaagctatcgacggtgataccgcacaggtaggtccgcaggtagcagaaaagctgggattaagccagattacttacaccgaagaaattctaaacgtggacgaaactgcccgccgcatcaccgtaaaacgccacattgacggaggggtagaaacagtggaaggtcctctgcctattgtactgactgtgaacggaagtgcagctccctgccgtccgcgcaatgccaaattgttacagaaatacaaacgcgctctcggcgcacaggaaaaagcagccatcactaaagacggttctgaactgccttacgctgaactatatgaaaaattcccttacctgaatatcactgaatggagtgtggccgatgtagaaggcgacaccaagcagtgcggtctgtcaggctctcccaccaaagtgaagaagattgaaaacatcgtcttccaggcaaaagaaagcaagaccatgacaggaagcgaccaggatgtggaaggattgattgtcgaactgttagctaaccatacaataggataacgattatgaataatgtatttgtatattgcgagattgaaggcacaacagtggccgatgtgagtctcgaacttttaaccaaaggtcgtaaattagctaatcagttaggctgccagcttgaggcaatcgctgccggaaccggccttgcaggaattgaaaaacaagtattgccctacggagtagacaaacttcatgtattcgatgctccgggtctgttcccttatacttcactgccccacacttccattttggtgaatctgttcaaagaggaaaaaccacaaatctgtctgatgggcgctactgttatcggccgcgatctgggaccgcgtgtatcttccgcattgaccagcggactgactgccgactgtacccagttggaaatcggtacccacgaagacaagaagaacggcatcacctatgaaaatctgttgtatcagattcgtcccgccttcggtggtaacatcgttgcaaccattgtcaaccccgagcaccgcccacagatggcgaccgttcgtgagggagtgatgaagaaagagattctggatgaaaattataagggtgaagtggtgaaccacgacgttgccaagtttgttcctgaaacagactatgtagtcaaagtcattgaccgtcacgtagaaaaagccaaacataacctgaaaggcgcacctatcgtgattgccggaggctatggcatgggatctaaagaaggttttgacaaattgttcgaactggccaaagaacttcacgccgaagtaggtgccagccgtgcagctgtcgatgcaggttatgcagaccatgaccgccagattggccagacgggtgtaaccgtccgtcccaaactgtatattgcttgcggtatctccggacaaatccagcacatcgcaggtatgcaggatgcaggtatcatcatctctgtaaacagtgacccgaacgctccgatcaacaccattgccgattatgtgattaacggcactgtggaagaagtcgttccgaaattgattaagtattataaaaagaattcaaagtagtcagtagtagtcataagtagtcaaagtagaaaaaaatgaaaagtcaatcctttgaacaactgattgtttggcaaaaggcacattcgtatgtattggccatttacaaaataaccaagcaatatcccaaagaggaattattctgcttggttaaccagatgcgccgtgcagcagcctctatcactgcaaatatagcggaaggatatgctaaaatcagctcaaaggacaaactgcgtttctataacatttcacaaggttcgttggaagaaacacgcaatttcattatcctgtcgaaagatttaggatacatcacattgcaagacaaagaacaattaggcatacaagcggccgaaatcagccgcctgctaaacgcctactgcatagccttgttgaaaaatgtatcgccacccactacttaactacccttagctactattaaccactctaactactaaaaattatggcaaacttttataccgatataccggaactcaagtatcacttgaacaatccgatgatggagcgcatctgccaactgaaagagcgcgactatagagataaagacgagttcgactatgcaccgcaggattatgccgatgccatggactcttacgataaaattctggaaatcacaggtgagattacaggtgaaaccatcgctcccaatgccgaaggagtggacgaagaaggtcctcactgcggaaacggacgtgtggaatatgcttcaggaaccaaacaaaacctggatgcgatggtcaaagccggactgaacggcatgaccatgccccgtcgtttcggtggcttgaacttccccatcaccccctacaccatgtgcgcggaaattgttgccgccgccgatgcaggtttcggaaacatctggtctttgcaagactgtattgaaacgctgtatgaattcggtaacgaagaccagcacagccgtttcattccccgtatttgtgcaggtgaaaccatgtctatggacttgaccgaacccgatgccggttccgaccttcagtcagtaatgctgaaagctactttcgatgaagccaacaactgctggcgtctgaacggtgtgaaacgtttcatcactaacggtgacgctaatcttcacctggtattggcacgtagcgaagaaggaaccaaagacggacgtggtttgtctatgttcatctatgacaaaaacgaaggaggtgtagatgtacgccgcatcgaaaataaattaggtatccacggctctcctacctgcgaactggtttacaagaacgcgaaagccgaactttgcggtgaccgtaagctcggtttgataaaatacgttatggcattgatgaatggtgcgcgtctgggtatcgctgcccagtcagtaggtttgtcacaagctgcttacaacgaaggattggcatacgccaaagaacgtaagcagttcggaaaagccatcatcgatttcccggcagtatatgacatgctgtctatcatgaaagccaaactggatgcaggccgtgcattgctttaccagacttcacgctatgtggatatttacaaagcattggatgatattgcccgcgaacgcaaactgactcctgaagaacgtcaggaacaaaaagtctacgccaagctagcagacagctttactccgctttccaagggtatgaactctgaatatgccaaccagaatgcatacgattgtatccagattcacggtggttcaggtttcatgatggaatatgcttgccagcgtatctatcgcgatgcacgcatcaccagcatttacgaaggaacgacccagctgcagactgtagccgctatccgttatgtaaccaatggttcttatatcgcaaccttgcgtaattatgaagctattccttgcagtgaagatatgcaaccgctgatggaccgcgtgaaagaaatggccaacaaatttgacgcatgcaccaatgcggtaaaagaggcccagaatcaagagttacttgatttcgttgcacgccgtctttatgaaatggctgccgtatgtatcatgtcacatcttcttatccaagatgcgacaaaagcacctgaattgttcgccaagtcagcccatgtatatgtaaactatgcagaagctgaaatagaaaagcatttcaatttcatccgtaaattcaaagcagatgatttagctgactatcgtttgtaaacttcattccattctataaaacgacgttctattcttcacggagtagaacgtcgtttatagtataagatttacttttaaacacatactgatgcaaaatcaaaaacgcccgtttcacaacgagcgttttccttataaacaaagcctcagccgaccttatttactaacaaacttattattaacgtatttataaactgcctcttcatatccttcctacaactatatcaatccctctatccagacaaactaataatccgtctacctttctactacccgatcttgattctcaaactttttctttttccaaaagtaaaattaaagctttatcatcattggaacaagagttatcgaccaatctccttatttcatctattaacacccgtttttgttccttatcacactatttcgaacttttctttccacctactgttatgagagaaacttattaaaaaccttgacttatgaaagaattagaattaaccagtaacgccgctttgacggatgcggtatatgaaaccgccctgaacggctcatttcttgaagttaaacttgtagcaggttccgtgggcgatgacgaacctagaggaatgcaaccggaatatgaatgttatcacatcagctatccggacaaaaaagacacaattttgttcgagcaacctttggatgctgccgatgacaaagtaaccgtatatgatttgggaaagaaaatcaaatccatagaaggctgttgccacaagacactgacaaaaggcgaaagccgcacagccacagcacgtaaagtagttgctcatggtcccatgtggatttatgtggctattgctgtcgggatggataaagcaggcaccgaatcaccttttatgatcgtccaaggagcaggcacttacggttctgaagatacgaccgagaacgaaatgataggttatgctaacggacgtattcatgaaatgacagctttgcttgtccgccgtgcgcgtttggaaaaactgcatctggcaagcatacgcgcaggctacaaatatttattcgtagaaccgggaagaataggaaaggctaaagtcaaagaaggataagcccccttgtcttcactgataaccatcattttaaaagcctgttgccttctttcaacaacaggcttttatctattataaattattctaacgcatctaccggcaaatcagactctttacgataccccgatgaagtaaatacagctatcagctccccctgtccgtctgttatctttacttcaacaaaaggaatacgatgatgattaaatacttcaacagcctcagcatacacgtaacccaacttagcaggacggagaaaagtaatattggcattcacagaaagtgtaagtttcttacggctgttcgctacagctgcaaaagccagatcggccaatgtaaacaaggcgccgccttgacatactcctccaccattcagatgccggtcggtcacctccatacacgcacgggcataccccggctttatctcaagaagttccactcccgcacaagtagcaaaacgatccgctttcaaaaattcttttaatgttgccatatcacaatttatatgaataagaaagtcttaatgaataatcaccatggtagccccgaaaccatattcacggaacgaagcatcctgactttcatagtttttatatttatattttaactcctgcaggatagctttgcgtaacacaccatcccccttaccatgaataaagacaatcttctgtcccttcttgttcttgcattcttccaaagtcttacgaaaaacgtccaattgataattcaatatctcgctgttgctcataccggcagtcgtatccagtaactcatgagcatggagatcaacctccatgatatcgttcttcacctttttctgctggggctgcttcgctacctgcggttccggcacttttttttgcaataatgcatcttttatatcatctgccgaaacaaacacctgttttaccggaacatcatttttcactatatcgtaaataagtgacggctcctcaaagaaaatactctcacggaaagtatgcaatttataaaacttcactgtatctatgcgcaattccacagacacggcaggcttgaacagaaaactcttgttatccttaaaagcgataagctgcacggccacccgttccaattcattcaaaacgcttttctcgaactcctcgatataaaacttcgtattcggttccaccatgccatggctgcgcacccgccagttactaccttcggctgtaagataagtaaagtataaggtgaaattgctgtcgttgataagatatgcatcaaatgccgttgcagaaatagctttgagatcctgtggcacaaaagccagcatcacattcagaatatcccctccctttcgctcagccgggcgataagtgacaggacgttcatcctcctcttcatccggacgcaccttgactgacgctccttttgcctttgcaccggcaacctcctgtttaggagccggagcaacaggtttacgcttcatattataatcatccgtgtcaatcaccacacactcctttatgggcatcggaatatcgaagccatcggcatcttctaccaaaaccatatcttttccttgaaatccggtcacaacaccgccccctacctcactaaggaaacggactttatctcctattttcatactcttttcttttttagttagcgcaaatatcggtacttttgcgcagaaaaagaaatagattcagatggaagataccaaacatatcaaaataagtgagttcaactacccgctacccgatgaacggatcgccaaattcccccttgccacgcgcgaccagtccaaactgctagtttaccgccacggcgaagtgagcgaagacatctttacgtctttgccacactatctggaatccggagaactgatgatattcaataataccaaagtgattcaagcccgtctgcatttccgtaaagaaaccggagcattaatagaagtattctgcctggaacctgtccagcccaatgactatgtgttaaacttccagcaaacacgccaatgcagctggttatgcatgataggtaatctgaaaaaatggaaagaaggtacgttgagccgcatagtaaatgtaaaaggcaaacaaatagtcctgtccgccacccgtggagagtgcaagggaaccagccattggattgatttctcatgggatgatgacacaatcacctttgccgacctgctggaagtggcaggtgaactgcccatccctccctatctgaaccgtgagacacaagaaagcgacaaggaaacttatcagacggtttactccaaaataaaaggttctgtcgccgctcccaccgcaggacttcattttacggaaagagtactggcagcgctggacgaacggggaattgaccgtgaggaactgactttacacgtaggtgcaggaactttcaagcccgtaaaaagtgaagagatagaaggacatgaaatgcatacggaatacatttctgtaagcaagcataccattgaaaaactaatcgcccataatggaaaagccattgcggtaggaaccacttcggtacgtaccctggaaagtctttattatatcggcgtccttatcagccacaatcccgatgccactcaggacgaattgcatgtacagcaatggatgccctacgaagataagaatgacctgactccggtggaagcactgcaacagattctggattatctgaaccgacacgaaatggaagcgttgcatagcagtactcagattatcatcgcgccgggatatacatacaaaatagtcaagaaaatggttaccaatttccatcagccgcaaagtacattgctgctattggtttccgcctttgtgaaaggaaactggcgaaggatttatgattatgcactgggccatgatttcaggtttctgagctacggagacagttcgctgctgataccctaagacttcatcacggatataaagccttttttccgtatcaccaaacgttttctactatatggctaaggcttttcttcctgcttgttttatctccgcaagcctttggagttatctcccaaggcttgggagttaactccaaagcttatggagataactccaaaggctatggagatagaatacatccgtataaaaaggcttaatttggagaaagaaaaaacttatgcaataggctgtgatatgatagacattcatttattccgccggtaggttcttacttaaaaaaatccaaagaaagatataaacgggaaaataagaaccagcttccactaaatttctaccgccccctttatttactatacacaagaacaggcaacctactttgtcattatggcaagctttttatatccgtgtgcgtttacctttacatcaagtctatagataaaaaacaactttatgtcactaaacatatctccaaacccatagtattccaatcattttgctatctttgtgacaaaacacttacatactatgactatcactctatctactgatttacctgcctatcctacattcacggaaggcatccgccgtgctcccgaccggggctaccgcttgacacccgcccaaacggaaacggcattgaggaatgcattgcgatacattccggtggaactgcatgagcaacttgctcccgaattgatggatgaactgctcacccggggtaaaatctacggttaccgcttccggcccgaaggtgacttgaaagcaaagcccattgacgaatataaaggaaactgtatcgaaggaaaagcgtttcaagtaatgatagacaacaacctttcatttgatatcgccctctatccttacgaactggtgacttacggcgaaaccggacaagtttgtcaaaactggatgcaataccggcttatcaagcagtatctggaggtaatgacgaatgaacaaaccctggtcgtagaaagcggccacccgttgggattattcaaatcacatcccgaagctccccgtgttattatcaccaattccatgatggtaggcatgttcgacaaccagaaagactgggaaatagccgcacagatgggagtagccaattatggacagatgaccgccggaggctggatgtacatcggtccgcaaggtattgtacacggcacgttcaacaccctattaaatgccggccgcatgaaattaggagtgccgcaggacggcaacctgaacggccatcttttcgtatcctccggattgggcggaatgagcggagcccaacccaaagcagccgagatagccggagcagtggccattatagccgaggtggattattcacgcatagaaacccgccaccgccaagggtgggtacagcatatcacatccgatttgtctgaagcttaccggctggctgccgatgccatagaccgacgaatcccctgttccatagcctaccatggcaatgtagtcaatctgttggagtatgcattgcatcacaacatccacatcgaacttctcagtgaccagacttcctgccatgccgtttacgaaggcggctattgtcctgcaggcatttccttcgaagaacgtacccgtatgctgaaagaagacagagaaactttcgatgaaatggtgaacgaaactttgcgccgccatttccatgttatcaaggaactggtggcacggggcacttatttcttcgattatggcaattctttcatgaaagcgatttatgacgccggagtgaaagaaatctcacgcaatggaacagacgagaaggatggattcatctggccgtcttatgtagaggatatcatggggcctcaacttttcgattatggttacggtcccttccgctgggtatgcctgagcgggaaaaaggaagatttgataaagaccgaccatgtcgctatggagtgtatccctaaagatcgccgcggccaggatatggacaactggatatggattcgcgacgccgaaaagaataacctggtggtagggacccaagcacgcattctgtatcaagacgcgctgggccgtatgaatatcgcactgcgtttcaatgaaatggtacgccggggcgaagtaggtcctatcatgttgggacgtgaccaccacgatgtaagcggtaccgactctcctttccgggaaacctccaatatcaaggacggcagcaatgtaatggcagatatggctgtgcaatgctttgccggaaattgtgcccggggcatgagccttgtcgctttgcacaatggaggcggtgtaggtataggtaaagccatcaatggcggattcggaatggtatgcgacggcagtgaacgggtagaccgtattctccgctcatccatgttatgggatgtaatgggaggagtggcacgccgctcgtgggcacgcaacccgcatgccatggaaacttcggcggaattcaacgagagccatgccgatggttatcacatcaccctgccgcatatagcggaagatgaccttattaataaggtattgaaaaataaaggaatcaactaaccaaaaaccggaacaccatggatgcaactgtttcattcatccgcatccatggatgttccctataaaccaaattctaaagagtatgagctggacaaaaattatggaatgcgtccccaacttcagcgagggacgtgacttacagaaaatagacgagattgtatctccgtttcgtgccaaggcaggcgtaaaattattggattatagtaacgatgaagaccacaaccggctggtagttaccgttgttggagagccggacgccttgaaagaagccgtgatagaagctatcggtatagcagtagaactgattgacctgaaccatcaccaaggacagcacccccgtatgggagctgtagatgtagttccattcattcccatcaaaggatgtaccatggaagatgctatagcggtgtccaaagaagtggggcaacgggtggcctctcaatataatctccctgtattcttgtatgaaaaatcagctagtgcaccacatcgtgaaaatctcgctgccatccgtaaaggagaattcgagggaatgaaggaaaagattcaccaacccgaatggcatcccgattttggtcctgcggaacgtcaccccactgccggaactgtagccatcggagcccgtatgcccttagtggcctacaatataaatctcaatactcccagcctggaaatagcgcatgacattgccaagaaaatccgttttatcggtggcggactgcgctattgcaaggccatgggcgtagaactgaaggaccggggtatcacccaggtatccatgaatcttaccgactatagcaaaaccgctatctaccgggcattcgaaatggtacgttttgaagccaaacgctacggagtaagcatcatcggcagcgaaatcgtaggacttgttcctatggaggccttgatagacactgcctcttactacctgggattggaaaacttctccatgcaacaagtgctggaagcgcagattatggaataatatagaatagaacgcaaatgacacaaatgacgcaaatagcaagtcaagaagatgtagataaaatattaaaagcattttatctagtgtacaacacattaggatatggattcttggaaagggtttatcaaaatgccctctactttgaattgatagagcaaggttttaaatgtgaagtgcaaaagcaaatcaatgtattttataaaaatcataaagtgggtgaatattatgccgacatggtgatcaacaactccatcatattagaactgaaagcggctgatgctttacgtcccgagcatgaatttcaactgataaactatctgaaagccacagacatagagataggctatctattaaacttcggaaagcatcctgaatttaaaagaaaaatattcagtcaccattgatatttgtgtcatttgcgtcatttgcgttccattaaaactaacaactatgagcaacaacttgattatcatcaatgcccacatcgttactccgcaaggcagaaccgcccggaaaggagaagccatgaacgaacttctcaacattccttgcggaacggtaagagtaaccgacggcattattacctatgttggcgaaaaccgtataagccatgaaaagcccggctataaagtgcttgacgccagagggaatgtattgttgccgggattcgttgactctcatacccatttggttttcggaggatttcgccccgacgaattcatctggcggctcaacggcgacagttatatgagcatcatggaacgtggcggaggcattatcaatactgtacgtgccacccgggaagcctcctttgaagaactgaaacataaagccgaatggtttctggataccatgagccggatgggggtcaccacagtggaaggaaaaagcggatatggtctggatcgtgatacagaactgaaacaactcagtgtcatgcaagctatcaatgaatgtcccgaccggaaagtagatatcgccaccacttttttaggtgctcacgccttacccgaagaatacaaagggcgaagtgacgcatatattgattttctgattaacgaaatgttgcccatgatccatcagaaacaattggccgaaaattgcgatattttctgtgaaaaaggagtattcactgtggaacagtctcgaaagctattgaaagctgcgcaagctctaggcttcggcgccaagctacacgctgatgaaattgtcagctttggaggagcagaactggcaggagaattgaaggccctcagcgccgaccatctgttgcaagcatccgatgaaggcataaaagccctggcacaaaataatgtagtaggcactctgttgccactaactgcctttacactaaaagagccctacgcccgtggcaggaaaatgatagacagcggctgtgccgtagcccttgccaccgatctaaatccaggcagctgtttctccggatccatcccgctgacttttgctctggcctgcatctatatgaaactgaccgttgccgaagctatcacagccatcacactgaacggtgcggcagccctcggacgcgccgaccgcatcggaagcatagaagccggaaaacagggagactttgttttactgggaaccgacaacccccatatattaccttattatacaggtatgaacgcagtgaagctgaccatcaaagggggacgtattctacattcaaattaaccaattaaatactaatagccatgttaacagaacttaccatcaaagaatttatcaataaagtactcagtaatgatcctgtccccggtggcggcagtgtctcggcactcaatggagcccttgccacctcactggcagctatggtagccaatcttaccataggccgcaagaaatatgtagaagtgaacgaaataatggaagatctttctgtgcgtttcgaagagctcacccgccagctgataaccgatgtagaccgtgattcggaagcatacgaccgtgttttctctgcattcaaacttccgaaagaaacggatgaagaaaaggctatccgcagtgaagccatacagaaggaaaccaaatatgccgcccaagtgcctatggaggtggcacgtaccgtccattccattctgcccatgattgatgtggtagccagaaaagggaacagcaacgctgtaaccgatgcctgtgtatccatgatgtgtgcccggactgccattctgggagccttgctgaatgtacgtatcaacctcacttctatcaaagacgaaaaattcgtcaaagagatgagtgaagaagccgatatgatagaacagacgaccattgccgaagaacagaaaatactggactatgtgaaaaccattttttaatcccaacctccgcggttaaaaaaagaatcagaccatgaagaatgtatatcaaataggttcgggtgacctcacttttgacatcatcgaacgtattatcaatgaaaatctgaaattggaactggctcctgaagccaaagaccggattcagaaatgccgggattacctggacaaaaagatcaaggaatccgatgtccctctctatggcatcacgacaggattcggcagcctgtgcaaccgtaatatttcttccgatgaactgagtactttgcaagagaacctggtgaaaagccatgcctgcagtgtaggcgcagaaatgccccatgtcattgtgaagctgatgtttttattaaaagctcatgctctttctttgggacacagtggcgtacaagtcattactgtacagcgcattatcgactttttcaataacgatgtaatgcccattgtctacgaccgcggttcattgggagcctcaggagatcttgccccgctcgccaatctcttccttccgttgatcggcgtaggcgacgtgtattataaaggcaaacgctgcgaagctatcagcgtgcttgatgagtttggttgggaaccagtcaaattgaaaagcaaagaaggactggccttgctcaatggtacccagtttatgagtgccaacggagtgtatgccatactcaaagccttccgtctttccaagaaagccgacctcattgccgccatctccctggaagcctttgacggccgcatcgatccgttcatggactgtatccaacaaatgcgtccgcataaaggccagatagaaaccggagccgcattccgaagaatactggaaggcagtgaaatcatcgcacagcccaaacaacacgtacaagacccctattcgttccgttgcatcccacaagttcatggtgctaccaaagatgccatcaaccacgtagcttcagtactgttgaccgagataaattcagttaccgataaccccactatcttccccgatgaagaccttatcatttcaggtggcaacttccacggacagcccctggcactggtatatgattatcttgccattgctatggccgaactgggaaacatatccgaacggcgtgtggcacaactcattatgggacttcgcggattgcccgaatttctggttgccaatccgggacttaattccggtttcatgattccccaatatgcggctgccagcatggtaagccagaataaaatgtactgttatgccgccagcagcgactccatagtatccagcaacggacaggaagaccatgtaagtatgggagccaacgccgccaccaagctctacaaagtgatggacaacctggaacatatacttgccatcgaattgatgaacgccgcacaaggactggatttccgccgcccgctccgcagttcaccgtttattgaaaagtttctcgccacctaccgcaacgaggtaccttttataaaagaagatattgtgatgtataaggaaatacataaaacagtagcttttttaaaacggcatcaagtaaattattaaacggcatttcggactcggattataaaggtctcacatccctttttactattaaagactataagatccatataatccgagcccgaattcatatctttgcagtaacaaaaaaatagcgaagatgaattacgataataaagaagaaatgtttcctatagtagatgaacaaggaaacataacaggagctgcaacccgtggagaatgtcataatggaagtaaattgctacatccggtagtccacttacatgtattcaacagtaaaggcgaactctatttgcaaaagcgtcctgactggaaaaatatccaaccaggcaaatgggacacagccgtaggcggacacatagatttaggtgaaaatgtggaaacagccttgaaacgtgaagtaaaagaagaactgggcatcaccgactttactcccgaattactgactagctatgtattcgaatccacccgggaaaaagaattggtattctcacataaaaccacttatgacggtcccattattcccagcgaggaactggatggcggccgtttttggtcactagaagagatcagaaacaatattgggaaagaaatatttacacctaattttgagaatgaatttcagaagctgggcttctgaaatagttttttaatgaaaagtggcaaattcttgatgcaggtcaagaatttgccacttttgcatacattttatctttatcagagtacaatctagaacaaaacagtataattttgtgttgtaaaacataaaaagaaaggataacgagattatgaaaaaggtaaaaagtatttttaaaaaagcccttgctatgatgggtgaaaacgaagtaaaagcttggggtatagggattaagtaagaaaacaaccctattttttaatcaaagaaaggataacattatgaagaagttgaaggagatcatcaaagcaggtctcaaagatatgggaaatgacgccctccgtgcttgggggtacgatacaaagtaaaagatacaaaggattagtttttaacgttttaaaaaaagggtaacaggatgaaaagagtaaaaagttttttcaaaggatatatgagggctattgaaattaatgccgcattaatgtatggttatagacctaaataaaaaccgtactttttgattgagggaattgaattaccattataataaaaaagcagtcttgacttttcaagactgcttttttattataaatacagtagaagtgaaatcaatttatccgacaagcaatacactaatattaaaaatatattgtatttctgcaaaaagaatatacctctttgaaatcaaagagttagaaaattcacctcattttaggataatgaggtggcaaccggcctaattaccgtgatctgcatcactttgcaggtttgggtaacttttaaggatgtaaatatggcaggcaataagatgatagacacgacctttctctacaatctcgctttttactcccggcaattcatttgccatctggaagaaaacatccatatctccattggcatccttgtagagtttcctgtaaatggaaagcacaccaccatccacgcaattcttgctacattccgaaaagaaggctgctcgttgttccgatgagagtcgggctatactttctcaaaacctttgaaccaatctgacaaatccatacaatcaaggtaattgactgaacagctttaccaatccttctttgttgaagcagtaaaacatttctatttgttcaggggtatcattctccagcaatagcaacaattctttagcaaattccaagtaacctgtgccatttgccgtaacaatgcgtttgtccgacacagcttgctcattcatataacctgccttattggtatagttgcctcctccccataattgtagctgttccaaaccatttcccgtatgttttatctcatttaagaaaccatgtttggcaaggaaagaagcagcattgcagatagctcctacgataatccctttctttatggcacggcgaacgattggcacgactttatctgcttccagttcgtcgagccagccgaaaccaccaattagtaccaatgcggcataatcattgggcatcgtttcaaaagaatagtcgggtaaagtatggaaaccactgcatgagcgtacaacatccaatgtaggagctacgactttgttcgtgtatttgggattttcttttatactacgttcgtcacacgcaatagccgaagccagaaacacggcttcatggtcggcatagttatttaacaatagatataatacctcgttcttcatatttattttcttctgatggtttgacatttacgttttgtcatctcttcggcaaaggcttgttcaccttgttccttaatatagctaatgcaagcggaacggtcagaattaaacagaaatgcaaatactttgcttatccaattggaaaacaacttgcattccctgacatcatgggagcattcagcacaagtattaaacttgttttcttggcaacatgagcggattttacaccaagttgcctttttatttggtttacatccgggacatttctctgccaagaacttacggcaagctccacaataaagaccgcaagcggctatgtttttattatcaggtacaatcgttctcataaatatcagatgttggagtgagaaaattcgccatttatccaaaaggtggcttccgtaccaatgaaatgtagaagtacataattgggatcacttggtccatcgggaaaatgatgaatgaaccaatcctgccatatgtccttgcggatagtatcgtccgtaataatttctaccgtaccacgcagggcaacgccatccccgtaatagtcatagcaaagccccgccttgttgttcgccttaaaatcattcactttcatggagccgacacttgtcaccatccagacttcattaaaacttttagcatgtatcttggacatctgcacaggtcgcggataaccgttggcatcaatggatgcaatggtcacattttcacattgggcaagcaagtgggttgccttttccattagtgtccgttcatctttttctttccaccgtttcaggtagggaaagtgttgaagcatttgttcctttgcttgtacgggactcaacttacattcggtctgcacattccattggtctaagaattgcaggcagaactcaatcatttggctcattgtaaaatcttgggtaaactcaccttttttgtaacaatacacgcaataatcctcactattgctcccatcggcatttgtccctctgttttcatcagttaggggcataccacaactttgacaaaactgttgttccatatatgtattctattcgatgcctatcagtccctttataggcggttataaaatgcgagagcgtggaactgcaatgctaccgcgtctaaattggaggtcgtagacaacctttggcacagatatgataataacagcccacgctatagcgtgagaaccactatactatttcttgtaccaagtccgagatttcctacgtttccaacctacaagatgaacataacgcttctcttttctcgtatgtcttggaaataattgcctttatccgactacaaaagtcggatatttttctgataatcttttattttctaatgcttttatttacttttagaatagaatttagggtacatcctatattttcagtcctttatcctctttagtagatgcagtttccaaaccgtttctccattcattcgctttctacctaaaccattgcacaagtggaacatcgttcacacctatttaaaaataccctttccgagaatctcaatgtgttccggcagaagtcaatcaacggcaatagcttttccacataagggaagttccataaattttgttatgtttttcaagataatcaaggaaagcaaagtaagttgatattagtttcacacggaaaacaacgtctgtatcccaaagaattagtacctttggaacgagataactcttcgcacttgcaatatactttttacgtattgcgtattttaaataatccattgcgtgtatttatcggcaagcgggatagtaaaaacataaaattgaaatggcaacagacggagtaaaaataattgatggagatttagcatacgacacctatgaacatataatggagttgtatgatagtggagcaagtggtgaaataattaagaaataaattccattcataaaagaagattatggagatgaaacggatttttatcacgaaatttttgttacagcttacgccttggcatttggggaaatcggagaactgactgatgaaattttaaaatgaagtaaaacgagttattgaacttaaagcaggtgtaaatctttggacaaaagatgtagacgaaaaggaaggcaaagaaagacaaaaagtccttgaccgatttttaaaaataatatctgcaccaaactcaaaagttagaaatagaaataatcaattttagttgctgcaatctgccgattttatgaggtttttccaacgatatttcctatttttgcaacaatttactattaacctataaatttcaattaaacagaaccatgattaaaaacctatctaccttcttcgtcggtatagcgttatcatgcctcgccggctgtaccccaatccccaaagaaacaactgcaacaaaagagtatgcgcctcttgaagttccagttcccgaacgtcctgcgggacaacaggatgtaatcgaactaacagctcctaaacttgacactgtgcgtgtaggtttcatcggtttgggcatgcgtggtcccagtgcggtagaacgttggacgcacataccgggaactaaaattgtcgctctttgcgacttattgcctgaaaatgcggaaaaagcacaaaaaattgtaactaacgccggtatggaagcccctgccctctattccggcagcgaagatgcatggaaacaactgtgcgagcgaaacgatatcgacttggtatacattgcaacagactggaaacaccatactgaaatgggtatctatgccatggaacatggaaaacatgcagccatcgaggtacctgccgccatgtcgctggatgaaatctgggcacttatcaatacttccgaaaagacccgtaaacactgtatgcaacttgaaaactgtgtttacgacttcttcgaactgacgacattgaatatggcacaaaaaggtcttttcggcgaagtgctccatgtagaaggttcatacatccataatctggaagaattctggccttattactggaacaactggcgtttggattacaaccgggagttccgtggagacgtttatgccacacacggcctaggccctgcctgccaattgctcaacattcatcgcggtgaccgcatgaagacactggtagccatggacaccaaagctgtaaccggtcccgaactggtaaaacaatatcagaaagaagaagcacccgatttccaaaacggcgaccataccatgacttttatccgtacagaaaacggaaaaaccatccacatacagcatgatgtaatgaatccacgtccctatagccgtatgtatcagctgaccggtaccaaaggttttgccaacaaatatcccatcgagcaatattgtttccgcccggatcagattgacagcaccagcatacccgatcacgaaaacctgagtatgcactcggctgttcccgaaaaagtaaaagaagctttgatgagccaatacaaacatcctatccaccaagaattagaagaaacagcaaagaaaataggtggacatggagggatggacttcattatggattatcgcctggtatattgcttgcgcaacggacttcctttggacatggacgtttatgatttagcagaatggtgctgtatggccgacttgacccgtctttctatagaaaacggaaatgcacctgttgccgtacccgactttacccgtggcaattggaacaaagtggatggttatcatcatgctttcgctcaataaaaaactgaaacaaatacagacttcaataaaaagagaggtatattctgcatcaggcagaaatacctccctttcttataatacacaaaatcacatgaacattattgtgtataaaaaaactcacattttatacttttgtcagttcacccgtcaccgaatcaattataaatcccctcactataatatcttcaggtattaatggatgctccataatagcccgtacagttcctttcaccgatttctccgtatcctcaaaaccatccagccatgctccaaaatctacaccacagaaacgaatcatatcaatggtttcctgcttgatgccacgtgctttcatgtgttctatcatctcattactattcatgtgacaggctccacaatcagaatgagcaacaaccataacttcctttacacctaactcataaatagccaccatcagactacggattacactaccaaacggatgcgagataaccccacctgcattcttgataatttttacatcaccgttcctgatacccaaagcagcaggtaacaattccgtcaaccgggtatccatacaagaaagaatagctatttttttatcaggatatttgttggtaatatatttctcatatcccttgctctcaacaaatttcttgttgaactctaaaatatcatctatcattgccataagtttttttaggattcactacaaacttacacaaaaataaaatacgatgacacttttaagataaatatttatcggatgccaacttttctaccatccatcaaggcaaagatgaaccatacaagaaaaagcaaagagaacaatgcgtttccatacgaaagaaccaaccccgtaaatgctaaaattgtcattggtcttttttccttctccccagttcggcacggatacggcttaacgactgtggggtaatccataaataagaagcgatatgcttcagaggtacatactgcaacagttccggattctcttccaacaaagtaagataacgctccttggcccgggggcttcctcccgttatcatccaactttcaagccctaaaaactgctgctcgaacagtcgtcttccaaaattagccagttcaacagatccggcatataatacttcgagttttgccttcgaaataccataaagttcactgtcacacatcgcttcgatggaaaccaacgaaactgtattttccacatatccccatgacgagaagatggcctctccttcagaagcaaaccagacggaaacatctaccccgtcattaaggtaatgcccccgccagattcctttacttacaatatagaagtttgagttccgcccaccttcctgtacaagaaaatcccctttatgaaaagtgaacttctccatattatccaacaactgcaagctcaaagctatcggcaaactatatttttcacaaaacttctgtatgaatgcatccatatatccacccgattaattactacaaaagtaaaaaatcatctgcgaacccattgatgtttacgataataaattaccattattactaaaaaagtaagtatttccgccaaaggaaccgccagccatatccctagcaccttcaatagcaacggcaagcccaataaacaaagtaccataaaaacaaacccacgcaaaactgtaaccatcatagccggacgtgcccgctctacactttgaaaatagccaatggaaacaatgtttacagcaaaaaaaataaaaccagacgcaaacaaaggcagtcccgccacagcaatatcgtatgccggataggaacgatcaataaacatagccacaatctgatgattgaacaaagctgttaacgcaaaaaacacaagtccgcaggtcacggccgttcccagtgccagacggaaagcggaacgtacccgcatggtatcacccgctccaaagttatagcttaaaatgggttgagccgattgtcctatggcattatataccataaatataatgggaaagaaataacaggcaatactgaaagcagccactccatcttcgcctaaataatggatgaacacataattgcctgcaaacatcatacaggctatggctgcctcgcacaaaaaggtggaaactcctaagtggcacatatatttcacattgcgccaagtgagccgcatactcttcttgctaagtttcacccggcaaaaatgaatcacatttcttctgcgacttaaatagactacaatcattccggcccccaaaatataccccagactggtagccagcgccgcacccatcattccccatttgagaataaaaatgaacacataatccaataggatattcaccactgccggaatagcattacacaacatggcataattaggagaaccatccaaacggacaaagaacatccctgaacttagcaaagcactaaataccagaaaaggcaagaaccaatacatatattccaccgccaaaggcaacagacgttccgaacttcccaaccacacggctacttgtggagcaaacaaacataccactccccacagcacagccaaaaacaaagaagaaaccacaacagcctgcgtcacattgatacgagcagttttcaactttccctgagataaatgaatagatgccaccaccgatgcgccaacaccaaacatcagtccgatacccgtacttatcaaaaacaaaggagcagtaatattcactgccgccaatgcgtcactacctatcccttgacctacaaaaataccatctgttatcacaaacacagccgaaaataccatccccagcacagtaggtatcagcaatttccgaaataatttcggaatttccatactaccaaaatcaatactatccttcataaacttcacttttttgtttagcggatgcaaagatagagcgttatttcggagtaaaaattaccatttggtaatttccaactattttttcataggaaaaaatttgttcttttaaaagatattcttacctttgcacccgctaaacaaaaagcaatgcctctttagctcagttggccagagcacgtgatttgtaatctcggggtcgttggttcgaatccgacaagaggctcactaaaaaaggaagtgtttctgaacgttcagaaacacttccttttttataggacagttcaatttgaaataaaccccactaatcttttaagagtgatccacagtctcctcacataacataatttctcggatgagccgaaatttagagagtaaataaaacttgagaagataatccactatggtctataaaaaactccctgtcaacatttcgccaacagggagtccgttaatcatttatggggcaaagattacatcatgccgcccatgccacccattccgggagcacccatcggcatttctggtttatcttctttcttttccacaattacacattctgtagtcaggaacatacctgcaatagaagcggcattttccaaagctacacgagttaccttagcaggatctaccacaccggcagcgtgcaagttttcgtaaacatcagtacgggcattgtaaccgaagtcacctttaccttcgcgtactttctgtactactactgcaccttccttacctgcattggcaacaatctgacgaagcggttcctcgatagcacgcttgataatttcgataccggttgtttcgtcttcattatcgcccttcaggccttccaatgcttcagaagcacggatgtaagctacgccaccgcccggaacgataccttcttcgatagctgcacgagtagcgcacaatgcatcatccacacggtctttcttttccttcatttcaacttcagaagcggcacctacataaagaacagctacaccacctgacaacttagccaaacgttcctgcaacttttccttatcataatctgaagtagtattctttatttcagctttaatctgattgatacgttcctgaatgttttcttttgcgccggcaccgtttacgatagtagtattatctttagaaacagttaccttatcgcaagtacccaacatttcaagagtagcttgttccaacttcaaacctttttcctcgctgataacgataccacctgtcaatacggcaatatcttccaacatcgccttacgacggtcgccgaagcccggagctttcacagcacaaatcttcaactgagaacgcagacggtttacaaccaacgtagtcaatgcttcgctgtctacatcttctgcaataaccaacaaaggacgtccgctctgtacagccggttccaggataggcaagaaatccttcaagttagaaatcttcttatcataaatcaggatgtacggatgttccatcacacattccatcttttctgtatcagttacaaagtaagcagacaagtaaccacggtcgaactgcataccttctaccacaccgatggtagtatccgttcctttagcttcttcgatagtaatcacaccatctttagaaactttacgcatagcgtctgcaatcaacttaccgatagtaggatcgttattggcagaaacagcagccacttgttcaatcttgtcatagttgtcacctaccatttcggcctgagacttgatagattcaaccactttggcaacagctttatcgataccacgtttcaaatccatcggatttgctccggcagtaacattcttcaaacctacccctacgattgattgagccagcacagtagcagtagtagtaccgtcacctgcatcgtcacctgtctttgaagcaacagatttcaccaactgtgcaccggtattctgaaatgcatcagccaattccacttctttagctacagtcacgccatccttagtgatatgaggagcaccgaatttcttttcgataatcacattacgacctttcggacccagggttactttcactgcgttagccaattcgtctacacccttcttcaattcgtcacgggcatcaatgttgaatttaatatctttagccataattctatttacaatttaatgatttacaatgtactatttaattatcccaaaacagcgagaacatcgctctgacgcatgataaggtatttcttaccgtcatgttccagttcagtgcccgagtatttgccatacaatacctgatcacctacatgcaacaccatctcctcatcttttgttccgttacctattgcgacaacttcaccttgcaatggtttttcctttgctgtatcaggaataataataccaccgattgttttttcttctgcaggagcaggaagaatcaatactctgtctgctaatggtttaatgttcatagttcttaatttttatatgttatacttttaattatatcaattatccgtcatctttaagcagtgacgcaaaacatcttgcgaaaaacgtgccaaacatgaaaaaggagaaattgacagttttattctgccaaattggcacagctataacatatctttcactaaaatggtttcctcttcccctgccattatcagttgcttttacgaaatttattatttttacctacaaagattcatatataaaccagtcggctacattccacagcgacagaacgaatctgaatataaaaagagaaaaatgtgatttttctttttttaatatttccataggacacaaactatcactatctttgcaaaacctaataattaacccctttaactatatggcatttacgaacaacattatgattgtccgccacagattactgacagaacttgtaaaattgtggaaaaacggagaactgacaacagacaaaatagaccgtctaccattagaactcagcccccgacgttcaaaacatgcagggcgttgctgcgtacacaaagaacgcgctgtatggaaatacaaatcccttcctctactggggctggatatggatgatgaaaccgatgagctcactccactatccgaatatgccgcacgtgctatagaacgtgcaaacaatggaaagcccaaagacaacattatgtgtgttatagacgaagcatgctcggcctgcgtacagatcaattatgaaatcaccgacttatgccggggatgtaccgcccgcagttgccagtacaattgtcccaaaggagccgtacatgtacatgccgacaccggcaaggcatggatcgaccatgatacctgcatcagttgcggcatctgccacaaaagctgcccttatcacgcaatcgtctatattcccgttccctgcgaggaatcttgtcctgtcaaagcgatcagcaaagatgaacacggtatagagcatattgatgagaataaatgtatttattgcggtaaatgcatgaatgcctgtcctttcggggccatttttgaaatatcccagacattcgatgtgttgcaacgcatccgtaaaggagaacaagtggtagccattgtcgcgccatctattttgggacaattcagcacaactatcgaacaagtatatggtgcattcagacaaatcggtttcaccgatataattgaagtagcacaaggagccatgtccaccgtagaacatgaagcgcatgaactgatagaaaaactggaagaaggacagaaattcatgactacctcatgctgcccgtcctatatcgagctggtgaacaaatacatccccgatatgaaaaaatacgtttccggcacaggctcgcctatgtattatgccgcacgtatagccaaagagaagtatcctgatgcaaaaatcgtatttgttggaccatgtgtagccaaacgtaaagaagctcaacgtgacgaggctgtggattttgtgatgacattcgaagagatttcctctattttcgatgctttcgagattaacctggaaattgtacagccatacgctatggaattctcttccgttcgcgaagcgcatggattcgcacaagccggcggcgtgatgggagccgtaaaggcattcctgaaaatggaagcggacaaaatcaatgccatacaggtatctgatttaaacaagaagaatatcggaacattacgcgcctacgctaaatcgggcaaagctcccggacaattcatcgaagtgatggcctgcgagggtggttgtatcacaggacccagtacgcacagcggcagcaacaatggaaaacgccaattggtacaggaactggcaaaacagaaaaaaacatattaaaggtatgcatgaagcgactgattgacaaattacgtcactaccatagcctgacaggtgaggaatatgccaacctcctctcctgtcaggataccggcactttactgtatttacagcaacaggccagggaagtcactttggcacatttcgggaatgggatatttatccgcggacttatcgaggtgagcaaccgatgtcgtaacaactgtcattattgcggaataaggaaaggaaataccgccattacccgttacgcattaaagcgtgaaaccattttggaatgttgccgtgaaggatatgcactcggattccgcaccttcgtgatgcaaggcggtgaagaccctgccttaacagatgaatggatagaaaaaaccgttgccgccatccactgtgaattccccgattgtgccatcaccctttcattaggagagaaatcacgggaagcatacgaacgtttcttccgtgccggagccaaccgttatctgctccgacacgaaacacacaacgaagaacactataggaaattacatcctgaggagatgtcactaaagcatcggctccaatgcctgcaatggctaaaagaaattggatatcaaaccggaacaggaatcatggtaggcactccgggacaaaccctgacacatctggtggaagatctgttattcatagagcaattccagccccaaatgatcggtatcggtccatttatcccccatcatgacacaccattcggaacagagccggccggaagtgtaggaatgaccctcaagctattatcccttttccggttaatgcacccgtccgccctgattccatcgaccaccgcccttgccaccttgtcaccggacggacgggaaaaaggaatattggcaggagctaatgtagtgatgcccaatctctcccccagggagcaaagagaaaaatacaccttgtatgataacaaagccgccttcggtgccgaagcagccgaaggtttacgagctttggcacaacaactggaaacaatcggttaccggatatcgacagatagaggtgactatcactaacccctaacaaacatgtataaagcagattctaaaatagcagaagaattcatagaccatcaagagatactggataccttggagtatgctcacaacaacaaaagcaatcgtgccctgatagagcaactgattgacaaagctgctcaattcaaaggactgtcccatcgtgaggcagcattactgctggaatgcgaccaaccggatctaacagaacgcattttccggctggcacaggaaatcaaacataagttttacggcaaccgtattgtaatgttcgcccctctatatctttccaattattgtgtgaacggatgcgtctactgcccttatcatttgaagaacaagaccatagcacgcaaaaagctgacacaagaagagatacgtaaggaggtaattgccttgcaagacatgggacacaaacgcctggcactggaagcaggagaagatccgttgcggaatcctattgagtacatactggaatctatccaaaccatttatagcatcaaacataaaaatggggctatccgccgggtcaatgtcaacattgccgccactaccgtggaaaactaccgcaagctgaaagacgcaggtatcggcacttatatcctgttccaggaaacttatcataaagaaaattacgaatccctgcatcccaccggtccgaaaagcaaatatgcttatcataccgaagcgatggaccgtgccatggaagcgggaattgacgatgtaggactaggtgttttattcgggctgaatacctaccgctatgactttacaggattattgatgcatgccgaacatctggaagctaccttcggagtgggaccacataccatcagtgttcctcgcatctgtccggcagatgatatctccacgcaagatttcccggatgccatttcagatgatatattttgtaaaattgtggcggtaatccgtatcgctgttccttatacaggtatgattatctctacaagggaatcggctgcaacccgacgcaaagtcttaaacctgggaatctcacaaatcagcggaggctcccggaccagcgtaggcggttatgccattccggaaacaccggaagaaaactcagcacaattcgacatcagtgacacccgtaccttggacgaggtagtgaactggctgctcgacttggggcatatccccagtttctgtacagcatgttatcgggcagggcgtacaggcgaccgttttatgtcattagtcaaatcgggacaaatcgccaactgctgcgcccccaatgcattgatgacactaaaagagtatctggaagattatgcggcaccggatacacgagccaaaggaatccaactgataaaaaaagagttggaacatattcccaatccgaaaataaaagaaatagcaattcgtaatctgaaagagatagaagaagggaaacgagatttcagattctaaccgctcatgcgtcaagcaaccttttcaatacagataatgaacctaattcaagcccaataaaatatgagtctaaacaacactcccgctgccaaccggctacatatcgtcctgttcggaaaacgcaatagcggcaagtcctctctaatcaatgccttgaccggacaagacaccgcccttgtatcggatattcccggtacaacaacagatgctgtcagcaaagcgatggaaattcaacatatcggtccttgtctctttatcgatactcccggatttgatgatgaaggggaattgggagaaatgcgcataacccgtacgttgaaagccatcgaacggacagatattgccttacttctttgtgaagacggcaattgcgaggatgaaaaacaatggatggagcagttaaataaaaggaatattccggttatcctgatactgaacaaagctgatatccgaaaagacatagcatccacaagggattgtatagaaaaagaatgcggtcaaagtcctctcattatcagcgcaaaagaacagacgggcatagagaaaatacttcaagctattctggaaaagttaccggcagatttcggacaacagaccattaccggagatctggttaaagaaggagatttagtgctcttagtcatgccacaagacatacaggctcccaaaggccgacttattcttccacaagtacagacgatgcgcgaattattggacaaaaaatgtctggtaatgagctgtacaaccgataaaatagccgccactttgcaggctctgtcctatcctccgaaactaatcataaccgactcccaagtttttcatgccgtttatgagcaaaaaccggcagaaagccttctcacctctttttccgttctgatggcaggatataaaggggatatactctattatatggaaggagcctcagccatagaccgcctcaccccacaatcacgggtattgatagcagaagcctgcactcatgcccctgccaccgaggacataggcagagtaaagcttccacgtatgttgcgtaaaaagataggtgaagagttgcaaatagatatcgttgcaggtacagactttccggaggatttgacaccctatcacttaatcattcattgcggagcctgcatgttcaatcgcaaatatgtactaaaccggattgataatgcccgtaagcaacagattcccatgactaattatggagtggctattgcacacttgaacgggatattggataagatagcgtattaaaaagacatctgttcttttttgtttccatcaccacaaaccatttatcttcaaaggtttgtggtgtaaaaggttccataattccccttaaccggtatgtatgtgtctttttaccattgtttctgaaggctcatagattttccttcttggtgtgtcctgtatgatggttcatccatttacttcatttacaaatacttatcgtgcaaacactttgttgcattatagtttcaccaaggtgaagcaatcgtatcacttgggtgactacgcctctccacttaggtgccaatgcattgtcacctaagtgaaacaacaaaagaagacagacaaagctacaaaaaaaacggacgagaatataaaaaggagtactaaacacatctgccataatgaccggtagctatcaggccgactccacacagggaaaggagaacaaaccatttcggaggggaaaaaggacttccgtcaccatatttcactgattctaaatgagatatagtgacggaagaaaaaaaaataatctgttaatccgcatagataattacggatgaatataccggactattccgacaacatccgcttgatgaaatcaagctttcaccaccgccagcaactcatccggtgtaaccagtgactgctcgcctgtagtcatattcttcaaagtcagtttcccttcgttcatttcattttcaccaacaatagcgacaaaaggaatctgcttgtcattggcatatcccatctgcttcttcattttagaagcatccggataaatttcagcgcgcacccctgcttcacggacttttgccaagataggcagacaataagcagcctctttatcgccgaagtttacaaacaacagctcggttccgttcaccgcttctttcggatacaaatccaactgattcaacacatcaaaaatacggtcggctccgaaagagatacctacaccagacataccatccataccaaagacaccggtcagattatcataacggccaccaccactgatgctgccaatctgcacatccaaggccttcacttcaaaaattgctcctgtataataattcaagccgcgagccaaagtcaaatccaattccacttcactcttcacacccagtgcagacacggtttttaatatgaattcactttcttccactcccttcaatcccgcttcactggtagcaaggacagtcttcaaagtttccaatttctcttcattgcttccactcaataaaataatcggctgcaatttatcaatagcctcttgaggaatccctttagaagccaattccgcatttacattttccaatccgattttatccagtttgtcaatggctacggtaatatctacaattttatcagcctccccgataatctcggcaataccggtcaatatcttacggttattgattttaattgaaacacgtactccgaatttaccaaatacacggtctatcatctgtaccagctccacttcattcaataaagaattgctgcctaccacatcggcgtcacattggtaaaactcacggtaacgccctttttggggacgatccgcacgccaaaccggttggatttgataacgtttgaaaggaaaacttatttcatcacgatgcatcaccacatagcgggcaaaaggtacggtgagatcgtagcgcaatcctttttcacagaacttgctcgccagctttaccgcattgcggctcagcaattcctcatcggtaatgccgttgaaataatcacctgagttctgtatcttaaacaataacttatccccttcgtcaccgtattttcccatcaaggtagacaaattctccatagaaggagtttcaatctgctgatagccgaaaagatgaaacacatcacggatcgtattgaatatatagttacgtttcgccatttccaccggcgaaaaatctctcgttcctttaggtatacttggttttgctgccataatgattctatttaatttattttgagccacaaaattacactaaatatttcattcgtaaaaagaatacttcttaatattgctcattgccggcaatattaagaagttaaacagctggtgccttaagtgcatatctcagtatgggccgtttccctacgaactcattgtttaataatttcgtaagctgtagaatgaacccctctattctctatttttccctccaatacatccaaagcgaactcaatgccccggacagccatctgtgagctgaaaatatcagctgttgcaaccagttttcccgtagaaagaaattctttcatcaccgcatcattatcaaagcccactacaggcagatagcaatttttttcttgcatctgctgaagaacccccaacgccatcgcatcattgctgcaatatacagctttcaaatcaggataccgcatccacatagcctgaaaaacttcggcggctttctccgtttcccagtcggccggttcggatgccaccaatcttaaccctttttcttctatcgccttgataaaacctcttttacgctgctgcgcattatcggctgccgtcaatccttcaataatagcaactttatcttcattccgcaacttcttatccaataatttacccacttcatacgcagctgcaaaattatccggtcccacaaaagccacttctactcctgcctgctccaatagctgagtatccaaccggatatcaatattgattaccggaactcctttcctgacagcctctactacaggctgaactaaggcttttgaatctataggaaccaatacgatagcatcgacttgctgatgaatcaaggaatacatcaagtcaacctgttcctctacctctgtctgtgtagccgttcccacacaaaccaaatccaaaaacggaagaggggccgcatactgaatggccccttctttcatcactttgaaaaaatcggcttgtaacgacttcattacaagccctattttataatttctcttcatctaatttttaatttgacaaagtaatgcttattaatccgataataaacaaggagaacatagccgcaatcagtttattggtccccttcggagcttccttaaattccttccagacaaaaactccccagatcatagccaccacaggcgctgcgttgctaagggcataagagatagccggattggcagcacctgctcccataaaactaatcaccatgccgtccatccagataaagcctcccagcatacctgtgagatgggtcttggcatcgccggcaaagtaatctttcatggtcaccgccttgccttctaccggatgcttcatggcaaaggtattgaatataggtgtgctggccagaatacctaccgcaaagaagaacacacctgtataaggagtcagcgttccggttcctcccgccacatactgcgggtcaagagatttcactaccaatccgtaaaagaacatgatagcaatgcctgccataatggccagcagaatccccttcttcggagtggaagccttgccggacgataactttccgtacgcttttccgcagatcagtatagctacaatgatgactaacacaccactccatagtaaaagctgatttccctgataggtctgaccggccaaagagattaataaataattgaatacaatacctccaatccaggccaagcctccaccgataggaaaacctactgacattccggctacagcaatggctgcggtaagaaatatattgccaaagttccacacaacaccgcccaagaatgcatattgaatgctagaccagtccatgactgccaaatcctgaaaaaaggtacggccttcacttcccatacttcccaaagtcaccgcccccaataaagctgtaaggaacagaccgacggtcaaatcccaataaaacagttcaaagctccattgcttggcggcaaccatcttctgcgtatttgcccaagagccccagcaggcacagcaaataacacagcagaggattgccaaaaagtaattatctaccaatatcatatttcatcgatattattcgtgaatatagatattccagttcagataagtttcaatagcttccgccaaaatatctttcacattgccacggcacatagccacatgatgttcgaatccattcttacaaatatatttcataagcggctgcagattatccaccttggttactgctatacaaccatccattccgtatgggtcatcggtcaggtcacctttgcccaaataagacttgatacaacccttcgtatcatctgtcgagatgcggaagaaggtgaaatcaccctgttttactttaccgtaaacggcaccgaaagtatgtaccttacctaatgttctgcccaacactcctaatgttcctaacttcaaatcattcattacaaatgatttagggaagttaccacaatgtgtacacacacacttgtcacgatcctcggcaaagttattgttccagtcaagcaatgccgacgggcgaccggaagccaatgtcaacgcatacatagacactgcaccggcaatatccacttcacaagcagcagggattaatttttcactcaacatactcatagtcacacaagctgcacaaccatagttttgctccaaagagtcccaacactggatagctacagcatcaatttcattggcttccatccattgttctacagccacaccaaatttagcctgcaaaatcagtttatcattgtattgttcgggaacagcagcatattgtctgatttctttcagttttgcttgtaacgtttcatcagcatcttcaatcttacgggcggcagacaagatttcagaaagatctaccggaacgactgtaatgcccgatgcctgcaacagtttctcgctggcgcggacggtctggaaaccggcaggacgagtgccgatggcaccgatgcgagcatgacgaagaccattcaccacccggcagatcgcagcgaacttattaatatcggctgccagcaaatcagaataaatagaataagtatgtagcgtagtatcagtaaaaggaatgccatactgatacaagttattgcatacggaaatcttaccacagaacgcgtcacgacggctatccaaatccaccttgtcattctcatcatcacatgcctgaaccaaaacaggcacattcagatcggctacactgatagcattgatgataccgatttcaaaaccgaagttaggtaatgaaacaatgattccatcaatgcggtcacggttctcacggaacaactttgcacatttcaagccatcttctcttgtttcaatactgctactgcctgtaggcgtagcatcttcggggagaatgacatagtcatagccctctttcgtcagtgtttccaacaattgtttacggacatcttttgctaattccgagttaaaataagcgcgtgttccaatgatgacaccaaaacacatttttttcttgtttttcatttctaatggtattaaaagttacgatatattcagttagttattctgtcctattactttcttaacagcctcacgccagccactatacaaagattgaagttctttttcctccatacagggagcgatgcaattgtcaatggtacgcatggcagcggcttcttggaaactggcccacttcttacgggcaaagccattcatgacaacagcccccaatgcagaagcttcctctatctccgaacggttaatgacggcatgcagcatatcagcctgaaactgcatcaggaactgattcttcgtggggcctccgtcaacacgcaacgctttcagctcgattcctgcctgccgggtcatcatgtctatcaaatccttcacttgataagcaatggattccaatcctgcacgcagcacatgcgcttttccagcattcagtgtcattccccagatggcagctttagcatccggtttccaccagggagctcccaatccggtaaaggcgggaaccagatagactccatcattgtttttaaccgaagtcgccaaggtttcaatttgattgaacgagtccaccaatcccaatttctccaccatccatttgatagtggctccggtgcaatggatattgccctcaaaagcataatacactttacccaaagccgagaatccgacggatgtaaccagcccttcaggagcagcgacagcctcttctccaatgttaaccataacagatgatcccgttccataagtcaccttgcccatacctgcctcaaaacacatctgaccggttaatgctccatgggaatcacctaaaacacctgctatttgtatcggagatttgaacaaaccctctatcgttgtttctccaaaaacagcatcacagggcaacgcttccggcatcatactccggggaatagtgaagagtttcaacaactcttcatcccagtccaaagtatgaatattaaaaagcatggtacgcgacgcattcgtataatcagtcagatgcttcctgccttcggtcagtttccaaatcagccaggaatcaatagttcccatcaacaaatcgcctttttctgccagttcacgtgcattttccacgttatccaatatccacttagcaccactggcagaaaaataaggatcgataagcaatccggtctttcgttgtaccagttcgctgtatcccttatctttcagttctttgcaaatagccgctccccgctggcattgccataccacggcatgataaacggacttgccggtatgtcggttccaaacaaccaccgtttcgcgctgattggtgatggcaagagaataagaaatatcctttccattcacttcttcttgttcaagcagacaatgtatcgcttctatggtatttttatagatttcttcggcatcatgctctacccatcctatctgcgggtagaattgctgatgttctatatttacccgatgcaacaattcgcaatcttcagagaacagcatggcttttgttgccgaagtactttgatctatggtaattattctgctaatcatactattagatttaaaaaggatatgtttattttttcacgaattcaagggcagtcttgcagatgccctctttatccaatccgtaatgggcaaagatttcatgggagtttccatgaaccacgttctcatcggggatgccgataatgcgtaccggaatcggattttcggaaagcgtctcaaccacaatagctcccaaaccaccaaactgactatgctcttccacagtgataattcttccggtttcttctgccgctttcctgatggcttccgcatcaacgggcttgatggaagacatatccaacacacgtgccttaatgcctttctcctgtaacatcaaaccagcttgataagcatgataaaccgtttctccggcagcaatgatggtcaggtccgtaccgttcagcagcatattagcttttcccagaataaaatcaaaatcatcattctcatacacatcgggaacagcagctcttcctacacgtacatacaccggttcaggataatctaccaatagtttgaccaacttgcgtgtctgacgggcatcacaaggaagaacgatattcattcccggaaaagttcttaatacggcaatatcatgcaggctatgatgagtagcccccaaagcaccataagcaactccaccacttactccgagtatcttcacattattctgactataagccaaatcgaccttcacctgctccaagctacgtgccacgtaaaagcaagccgggccacatacaaacactttttttccgctatgtgccaaacctgctgatattcctaccgcatcctgttcggctattccacattctacaaactgtgcaggtaattcttttgcaaaatcccccaaagtaacagatcctctggcgtctgttgtaaccgccacaatatctttatcctgacgcgccaactccagcaacgtatctgtaaagctctttctgcacgctatcatattatttgccattgttttctttttctagtttttcaattctttcggatacctcgcgaacagcctcttcatattgttcggctgtaggcacgccatgatgccattttgcaatgccttccatataagacactccttttccttttgtagtatgggagataagcaaatgaggctttttattcgtataatcaatagaacggaaagtccggatgatatcttccatctcatctccgttcatttccaatacatcccaaccgaaggcagtccagcggtcgcgcatactctccaatgacatgacctcctcggttgtaccgctgatctgcaaacgattacggtcaataatggctaccagattatccaatttatactggtttcctgccatagcagcttcatatatagaaccttccccttgctcaccatctcccatcaatacatacgttttataatcagctttatccattttggcagccatcgccattccgacacctacagacaagccatgccctaaagctcctgtatttacttcaatacccggtacctctatagtaggatggccggacaagatagatccgaattctcctaatgtgtcggttacctcacgagagatgaaaccttttgcttccagcgtaacatataacgcttctacgcaatgccctttgctcattacaaaacgatctcttttcgtttcctttggtttatccggccaaacacgcattatatcaaaataaagtgctgtaagcacgttaagacacgacagatcacctccaatgtgtcctgcttttgctttatacacaatctcaaccaaccgtttccgattcttttccgattgtaattctaacgtttcaacttgcatattattatcatttactttcttattctttcgcaaataacggaatttaactggaaacattcaatacaaaacgaaataaaatgaaaataaatttgattatattaacaataaacgcctaaataatctataaatcaggacaattaatttattctgctaacaaagttatatctctatataaacaagactctccgattgtctattttgtacccaacagaactgttataaaaaaagaagcaaacaataaggagaaataaggaagtaaaatcaaagttgataaaaaaggtgatcaagaatgtattttccaacattctcaatcacccatattacctttgtttcagtaagaatcagataacttcgacctctaattcttttaatctttcaaaatcctcttcggttatagtactatctgtaataatagcatttgctaatgaaaccgagcctaaactagcaaaagcactgacacctatttttgaacaatcagccaccagatacactttactggcagactctatcatagcagatttcacgaccaaatcacttagactaggataagtcagcttcatatccgaagaaataccggccgtagccagaaacaatttattagcgcgtatatctttaaatgaatcggccgccatttttcctgtcaaagaaagtgtaggagccttgaattcacctccggtaacaatcagattaataccatgattctcacctaaaatcaaagctatattcaaagcattggtaatgactgtcaggtccttataattcattaaaagctttgcgatctctgtagttgtagaaccggaatcaagaattatactgtccccctcctgaataaactgaatagctttctgagcgatttctttcttttcctccaaatgagtctgattgaacaattgcccggtcttggcaaacgaccctactcctttcagaaacgcacctccatgctctctttggatataccccatttgttccaaggcttccaaatcctgacggatcgttacatccgtcacattgaaaattttactaaggtcctgaacttttgcatgcccgtcttcacgaatcagatgcaatatctttactcttctttgattgagtgccatatttattagatttagaggttatgttttttacgatattcctgaatatccttaatggaaacaattttcaaaccgaattttgctgcaatctcacctagttggggaagacgcgccattgtaccatcttcattcaaaatttcaacaagagctcctccgggtttcaaacctgccattcttgtcatatccagtgtggcttcggtatgtccattacgctccaagaccccattttccgcaccatatagagggaaaacgtgtccgggacgagcaaactcggaaggattcagatttcctgccaccaaagcttttattgttgacgaacggtcgaaagcagaaactcccgtagtacagccataccctcttaaatctaccgacatagtaaacggtgtacctagcaatgaagtgttttcttctgccatcggagccagacaaagttcttcacaacgtgaacgtggcagaggagcacataacaaccctctgccatgagtaatcataaaatttacaatttcaggagtaatcttttctcctgaaacgataaaatcgccttcgttttcacgatcttcgtcatcaacaacgatcaatactttgccttggcgaatatcttccaatccttcttctactgtatttaacattttagtgtatctagggagttaattataccgcaaatttaagctaaaacaaaaagaatcgaaaactattagccttttttatgataaaaaaaatcaatcatctcccgtcagaaggcttatcccatcatttcacttctgttattctaagaacaatataaggagcatccggaattcttactccccgatgatgtatatcaaaaacacgataatccaattcctccgttgtttcaaatatcacaggatattccgtgacagtcatggcccacacatcaataatctccactttaaaccgtttattcttttgcaatttgttataatccgcattttttaccggcagattaaaagtccagaaacctttcacatcttttcccatattgaccagataataatctggtccagcagtagaagtaaccaagtcacgactgatatctgccatctccaacggatggggagcagcttcaataatcgttcttaaaaatttcacacgtttccagctttcaccttttaaagatcccccttgcgcccaaaagataggttcgttcccctgctgataacattcaccgtgagtgacataaattccacccaacaaaccattcaaaataaagcaagtcatctgctgcggacttaaccttccccaacgataaggtagattcccttcatacccaacctcatcacatataaccggtttgcgataaatttttcttaaagtagcagaagcggtagaactcagcaccggtgcctcatcctgtatgctgacatgggtaaattcaggcatccaataatcaaaataagtagccgtcgctccatgaatagaacataaatggcgataaggatcattctcaaccacagttttcgtcaacagcttccaatcatccacagttttcgcttttacataatcccactcgtttgccatagaccaccatacatttctaaaagaagccaaacgagcagtaatatatttaatataacgtacattcacctcattcgacatagcatcaaagccccatcttcccttatcataaggatggaaaaggatcaaatccgcctcaatccccaaacggttcagttggtctatccgtttctccaaatgctgaaaaaaagccgggtcaaatctgtcaaagtcccattctttcctttcatttccttccttatcttttatcgtcttccttatttcaaaaggataaagcgcaggctcgtctttcactaaagaatagtttttaggaaacacacacatccttaccttattaaaaccggcttcaccaaacgatttcaaagtagcctcctgagtcgtttccttcatatgtgtccatgcataggccgtcgtacccatcggataataacgggtaccgtccgcatatttaaaattatgttctccgtccaccaataccatgccatgattatcttttccggcaggtatcactgtgaatgtacctttccgaccattcatagcccctatactggaagatgtaacatacctccattccccggcgacagcaggcataaaccgtatcctataagtattctcaccatcataaaacccttccaccgttttcttttcctttccacaaacgaaagtagcggaaagacgtgtatcaaaaggattccctttggtcacctgtttaaaactcaactcaaaccggtcccaacattccactttgtcttgtgcatttacttttaccacaaaacttaacagcgtccaaacagctattacataaaattttgtactcatcctatcatgttttaaaaattatactcataaaagttttccggaacattttcatactgtgtcaatgagcacaaagatagattttacccttgagagccaaaggtaaaatcttacgtcaataaggtattttcttgctatttaccttcataaacagcacaaaacggaacttagttattatttttatactcagtcaaagtctgattaaatgcttttttaaacgccttgccaaagtaaccgggatcagagaagccgacggcaaaagcgacctcagagaaagacataccactttgtataaaacttttcgctttattcaacctataattctttatatattctatcggagaaatccccatgataccattcactttccgattgaatacagagcggctcatattcatgaactctgccagatcattcacccgcagccccggattactgtaattctcttccataaatcctaccagcttctgcataaacaactcgtccaaaggaacaatttgcgacacaggataagcgacggcttctaaaggttctttcttcggttgagcaccatactttgacaaaaaagccgactgaagcacttttctttgcctgatcaagttctcaattctcgattttaaataatcgctgctgaaaggtttaggtatataatcatcaatccctaattgtaaacattgaatacgatcctcaacagacgattttgcagaaaggataataagagggatatcacaggtattgacattctccttgatgtgccttatcaattcaataccatccatacgcggcatcataatatccgtaataataaaatccggaatttcctcttctatcttttccaatgccatcaccccgtcggcaactccaacaacacggtaagtgcccgacaatatttcacatataaattgacgcaactccgcattatcctccactaccatcacttttactaaagtttcttttgttgccggaggcatgtccggcaaagatattttatcattttgttccggttccgccaagaccgtttcctgttcttccgaagtgtcgttcaatatatattcaacatttttatcctgagcatatatttcttttcctttatgcaaaaccagtttgaatacacttcctttctttacttcactttcgacctgaatttccccatgcagcattttaaccaactcattcaccagcgaaagccctatacccgatgaaggctgcatgtcattttccttggacactgtagtgaaacgttcaaatatggatgacactttatctttagagatgccaataccttcatcttttacggcaatcgaaacaaactgtccgctttccatcacaatcaaggtaatcgacttgttatccggtgtatacttaaaggcattggaaagcaagttaaagataattttctcgaacttatcactatctatccacaaaaaaacagaaggcaacgttgtctgaagagaaaaatttatatttttttctgttgccaacaaccggaaattatccattatattatgaagcatgataatgatatcccggtattcaatagtcaagcccatttttttattctgtatctttctgaaatccaatacttgattaatgagcaataacatacgattgatatttttctgaaccaattgaagatgatgccgggtccgggaagtcaaaggctcctgggacaacacttcggataccggaccggatataagggttaaaggagtacgtagttcatgtgagatatcaataaaagaacgtacttttatttccgccaatctttgttccatatttaccttatgcttcaaatagtaaatatagaaaaaaacatatccgatagctaaagatatcaccaagacaacaactagataaaaagccttagcccaaccggtttcccaaaaggtgggtaatacctgtaaagtaaccgttttcacagtgttcatccaaataccatccccattggtcgcctttatctgaaattgatattttcctgccggaagacttacaaaactaaccgagttcttcttacctatataataccattgattatcatccaacttataagcatactcgatatccaaggaattagtataatccaacgcagcaaatgagatggtaaaattcctccgccgggtagggatctctaaataatccgcatcactcaatacatgagacaaattatcctccgaatattttatccctgtcactacaataggagcttcataagtctgcttaacgatactatccggagaaaagacaagcataccgccttctgtacccattaagatatccccttgcctgtctgtaaccggaagacattcactataattaaaagagcgattgaaaaaagtttctccaaaagactcaaaagtctgatcgtgcacatcaaacagagtgatatccgtttccgagccgatccatatattatgatttttatcttcaatcaaggctctagccaacggagatgtctctttgccgaacgaccggaaccgaagttcatcagataataaatttgacgaaaccaacttacaaaggccacctccataacaataacaatagatagtttcatccgtcgttcgtaaaacagacatcacatcagcactacacaatccgtcagtcgcctgcggacgaggaaggttaagataaaaacgaatattttcgtaatccgaaaaatcagaagaaaaagtgatcaaaccttctatagtacccaccagcatagtatgaccgggtccctccaccatacaacgaatactgttggtacgattaataggaaaaccggacaatttattctccgcatgaataaaacgtatcgccccatcttccttttcctcaaccaaattcaatccgccaccgtaagtaccaatccaaatacgtccgttatgatcctcatcaatgcatgatattttattgtcactgatggaataaggatccgacggattattcatataatgatatacctcataatgataaggacgattccgaggaacaagtctgaacaatccgttttccttactgccaagccatattgtctgcgcctgatccttcagcatgacatagattccaccttctgcaaaaactgtttccgtttgagccagttccccatcaggcgacaaataacccaacaagtttttctgtgaatccataatacgtataatccctttctttgttgcaatccataaatgttcgtcgctatcaaacagaaatgattttgtatcaaaataattgtccaactccctataagtatagggactgggcggaaagaacatttttataaatgagcgctgggatttgatccacaaattattttgtttgtcaacataagttgttttaataataggagaataaggtatatgattccttcccggtgtaaaatagacttttagctcccggctcttttcgtcataataactgaatatacctttataaggaatagtccaaaccactccgttaggatcttcataaataaagagttcattttccggagaagaagccatgtatccggaaggagtattcaaatattgtttcactccggtttccggatcaagccggataattcccggcaatccggtaaatatccatagaaatcctttagaatcctgatagacttttctcacagccgcatcatcacgccccggaagagagaaatcatatttctccatcgccagttcagggaaacggcataggtacaaacctttatcagacaaaacagccagctgattatctttcaacactttaattccgtttatatgctgaatcttctcttgaaaaggaacgatgttgaattgcatggtatttacatcataataggctagcctgccattctgtgatgcaagaaaaacaagattatccattgtttcgaacatagaaaagggatatgaactaatggtccgcttgccaaatatgctaactcccttgtcactaaatacccattcctctccctgtttatcttcaaagaccctactgactttccccagttccacatcatcaatagctgtaatatactgaatccctgaagaaacagtacactctttatctgaaattctgaaacatcctccattatttaaagtaacccaagtaatccctttggataaaggatacaaattttctatttgcaacggagtattaaaatgttgttcatactgtttcagaacattgatcagcttattttcacgaatatcatataaatacaggctatgacgatcgtatgcaatcatccataaattgccgtcggccgtattctccagccgctgcatgtgctggttcaaaagagaatcaaactgaaaagtttcgaaatcgcgtccatcaaaccggcttaccccattccaagtactgacccatataaaaccattatgactttgaagaatctgcgccggattactttgaatcaatccgtctctcactgtatattggcgtgcaacacaaataggctgtgctttgacaaaaccccaatgaagaagtaaaaacaaagtacaccatatatattttaactttattgtgtttctcatcatcaaattattctaaatgaccaagtatttgatggctcccaaatgttttttcataggtattatctcattttgctgacagggcaaaaatacaaattaaaacgaaaagaaaaagagattaaaacaaaaattatttcgaaactaatcaaaatataactagaaaaggctgcccgcaagcagccttctataataaaaatatatttcccttataaggtcttagtcacgacgtcccatataaatcattatatagtaaatcagtgtagccaacgaactaagtgccgcaaccacatacgtataagcagctgaacgcagcgcatcctctgccgcatgatggttatatgaatttgtaattccggccttgctcaaccataccaacgcacgctggctggcattgatctcaacaggcaacgtaataaagctgaaaagagtagtcatggcaaaaagacaaattcctgccaacaataactgcgggaaagtattcaccatcaaaatacctgccagtaacacccaagtcataatagaagatgagaactgcaccacaggcaccaaagccgagcgcatctttagcggagcgtatgcacgcgcatgttgcacggcgtgtccgcattcatgggcggcaactgccgcagcagccacactgttgcttccatataccccttcactaaggttcaccgttttgtttgccggattataatgatcggtcagcatacccggagtgctggttacacgcacgtcatagataccgttatcatgcaacattttttcagccacatcctttcctgtcataccgctggccaaaggcatcttcgagtatttcttaaacttgctttgcagactattctgtacaatatagctgattaccgcgattccaataaataagatccaatacattgacatagttttgttctttataattctgttgttaaatatacacgttattatgtacaaatagtttgccagcatcccccttttaaatagaattaagaattcctgccatcacacgcctccgaattcacatccgtcaatttcaattaaaaaatgatattatgaaaaaaaaagagtggattattgacttttgatttatacatttgaggcaaaattaagaaatatggaacatgaaataggaaatatatccatagcccgtatccgacagatgaatcccagtctaaaagggattaacaatgatttcgtaatggatagaagcgaacattacatccccgagaatatgaaccccatctttaaatacccattacggctggatggaatcattatctctatccgtgaaaaaggctctgccaaagtcaatatcaatttacgggaatacgacattgagcaaaacgatctgattatttgcgctcccggcgatattctacagtccatgttatcaccgggcattcatttgtcacaaatgtttttaatatcatctgatttcttaaaagagatgtatatcaacctgaacagtttcatgccatttttcatctcattgaaagagaatcccaaatttcatttgatggaagaagaggtacaggaactgaaatcattctatgaactgatagaagaaaccgtaagccggaacgataacttcaggacagaaatcgtacgcagactaatgggggcctatttatataagataggttccatccttcatagaaaacaaccggaattcctttccgagaatccgaaatcactgaaaagggaagaggtattgttcaaccagttcatcaacttgctgaccgaacatcaccgtaaagaaagacgcgtagatttttatgcggagcaattattcctgagtcccaaacatttctccaccgtagtaaagaaagtgagcggaaaaactgccggagagtggattgacgaatatgtgatactggaagccaaagcactgttgaaatactccgtcatgtctattcaggaagtagcttattttatgaacttcccgaacccttccttttttggcaaatacttcaagcaccataccgggttatctcccagcgaatacaagatgcaataatgaaaacagaagataaaaaatagtaatccaacgggggctgtccgaaaaaaaacggacagcccccgaaagtaaattatataagtgtgactacactacctctcatcttaaaataattttgcaggatattcaccggcatccaccaatgcctgtatcttgtcaaccacactctgacggtcttcaggataagttactccaaaccatttgctggtagtatccaatacctcaacggtagcagtaccgtcattaatcagcttgtccaccatcagcggaataaagaattcgctcttcaagttttccatatttttaggatcgctcaagaatgctttaaagaattccttgctgtaagcaaagtaatcaggagtaaagccccagaagttcatgctcaccggagttgtgtcaggggtagctgtccattcgccattgtcgtcaatatacttcacttctccgtctatgcgctgaattttggtacgttctaccacggaagtcaacaaatgatccgcattggttccacagatgccgcgggataccgttccactctcgctcaatgtatttcctacacggaagcccaccatagcatacgtgtttttagcaccttcgggcaatgcagaaaggaacttgcccattacctggaacgagtcacggccatagaagtcatcgcaattgatcaccgcaaacggttcctgtatcacatcagctcccatcatgacagcatggttagttccccaaggttttgtacgctccgcaggacaagtaaaaccctccggcagattgtctaaagcctggaataccagttcgcaaggaatatgaccttcatatttagaaataatcttttcacgaaaatcttgttcaaaatctttacggataacaaagaccagttttccaaagccggcgttgatagcgtcataaatagaataatccataatagtttcgccgttaggacccagaccatccaattgcttcaatcctccgtaacggctgcccataccagccgccaataaaaataaagttggtttcatagtttatttatttaaaattgaatatttgatggtacaaagctacaaaataatacggaggaaaaaagctacattccattcaaattcgagcataaatcaatcatttccctccttttgacgcaaatcaagccctatttctagaaaggatagccgatggcaaagtgcaatcccagtccatccttaaacttaggaatattataatatcctttcttgccggtatcatacggatcatgaagagcaatacccagatccaggcggattaccaggaaagtaaggtcataacgcaatcccaccccagtacccaaagctatacttttagcaaaattacgaagagtaagcaaaccgccgggacgtatattctcaccttcctcattcttttgttcacgcagcagccacacatttcccgcgtccagaaaagctgccccgtacaaatcacccaggatagggaaacggtattccacattcgcttccagcttcacatctccggtttcatccagataaccatactgtttatcttcgggacgataagaaccggggccgatagagcgcactgtaaacgcacggatactgttagctcccccaatatagaactgctcgctgtaaggcgctacagtctggttcccatatgcatacaaaattccccccatcaaacgagtggctatatgctgtttctctccgactttaaacaaacaacgcacttcggatgtcattttcaggaattgcgcataaggactgtttaataacttcttatctgtttccttgaatcccttcccaaaagcagcatacaccaacgaagtcagattacctgccgaagtaaaggaagtttcccaccataaattattgcgtttcttcaacggggcgttatcatacgtaaacgtataactcatagccgggataaactgatttcccaaactgattttcaagctccggttcttgtccactatcgtatcaaaacgtgtagtagtatgctgcaacgtattaaatgccagtctgaaaggagtcacagtatgtttccatacccgcgaaggctggaaatcgtatgacaccgttccaccgaaagaaagcattttaaagaagcgggcacggttcaactgactggcatacaacttgaatgaggtatgctgcggaaatcgcgagctcatcatttttttactcatccacggcaacaccaggcgaggatactccaatgaaaaagaagtccccaactcgtatgagttcaatttagaactgttcccgtccgccgtagaattggtctgccattcgtatgaccctttcaactggaaagaaagcgtggcggctgtacgcatgaaattcttccgcgagaggctgaaaatcgctccgggaccagtctgatccgtacttttggtagtcacattgaattccagttctccgtcatacggcaaatcgaatgtagcattcatccgcacattcagcgtatcacaccccggcaatgtatcttgcggggcatagcggaactcggcaaatttgaaaatgcccaaacgcgccaaggcttcctgcgtgaaattctgacgggcctgagaataaagctgccctttctggtaaaagaagcgcttagccaatactccggggcggataccgggtttcttaccgctatagtgtaaagtcattcccggaaagacgatggaatcagtaggttcctctcctttatatccggtaagataaacagaagtattccctatataataaggtcttttcgcatcggcaggcactccagctttcggaacaacctgcaaactgaccattcccggtttgcgcaaggtatccgcacggaaagtaatgaattcgggacggaaataataataaccattgttacggaaaagggtactcagccgctggcgctcctcctccagtttcaacacactgaaattatctcctttatgcaataccctctggtcataagcagccctgatcagactatcggcgcgaggaggatatttcagatacatgacagagtccagataataagggttcgccatatcaatcttataacttaacttggctttccgaggattcttcaacgagtctacagaataagtcacagcaccattgaaaaagccataatcatgcaacagattggtggccaccttcacacgggtttccggattcaccgtagacaaatacaccggagtagaccccagcttgttgaagatccaatgccccaccccctttttatcctggtatttcacaaaatcattgtatatccacaaaccgaaaggaatgggaaaacgcaaggagttgcttcccaaaatggcattattgggaggataagacaaagcagcctccacctcttccaaggtctggacaccggcaggggtcttgtcttcattcagaatctccatatttttcacaccgacatatagcgtttcgtcttccggcaaattcctggtagtagagcaggcaactgtcatcagcaacaataccgataataaaaacaggtttatgttatgttttctctccatatctccaacaatcattttttcttcttagacttgaaaataaacagttcgcccaggtgactcatcttcttgcgaagcacaatacccacaccggtttctatgatctcaccttccagcacactctcatagttcttgtcgtggaagagcttgacataccgggtaccgctgttgtccaagcggtattctatggatacattatcaataaaggtttcatcctgctgtaccgtacttccggtagacactttaccgcctaccactatacggaagcggttattccagaaacgtttggcgaactggaaattataatccgtgcgtttcccgccgctatcggcatcatccaccgtttccatgcccacattgatatcaagtgctttcccggcaatattcgagatttcgctctgcaggaatgagttcaaggcattattcacattaaatcctcccgtagagtttccttcagccatatacattccggtcaccagcatggtgacagccagttttccccgttcctccaccgacatggcattcagctggtcttgcacagacgcatcctcgggagccgaaagggtaaacgccagccccagattctccagactctggctcaaagcgatccctacatcaaacccgacgatacgcgaagtctttccatcctcgcccaccgaagcacggaccctttcggtcgcggtaatgttcagttgcggattcatgatatttcccgtccactccacataactgccattttgaatattaaaagtcttcagcggaataatcggaatctggtatttcatctccccgctcatcaaggaataacgcccagtcagcaacatatccccctgaggagtgtactggaatgacaagtctccgcctccttccagcaacatatagttggagccgtccggcaccagatccacacgtgcctgcaccgcctggtctatatgcatggtcatggccacatccatccctcccaaagagatttgctggacagaggactcctctaccgaagttgtgtcgttgaaattgacaaaagtcaccatatcccccaaacggtcgttcaccgtcaagggagagtctttcaggacataggtcacattggtcttccccaatatgttcatgttcccccgcatcaccagttcctccacaggaccgcgcagcgttgcgttaaaatccacatacatcttgccgtaaaccatagcccgcttggtacggggggcattcagcaactcataattctcggcatgcattttaaggttcaccgccgtccgttccaaatccgagaagtccacctcgccgttaatggtaaaaggagtcttgcctttggtgaatatatcgaactccttgaacatcatcttactgttcaccacctgcaccggttcattatcaaaacggaacatggcagacatctccggcatgaagaaagtcacggaatccaatgccagttccccattcagcaagggtttggccggatcacctttcatggacaatgttccatcaatatccccgtccagttccaccatgcggtcgggcacaaacggattggcgacattcagcggaaaatgttcgaaggctatatccgcgctcaggcttcccgttccttcctccgcgggcagatagatacctcccaaatgagctatctcctcaccatcatggcgtatataggcatccagatgatgatcctttgcctcaccgggcagatacacaccacccagttcccaatttcccaacgcactgccttcatatttgaattcatctatacgcaaatcactgctcaccatcatatacggaccggaatctatataatgcgcttctgctccgatccatccttccatatcaggcatatagggaaggatacgccggaattctttcagattgatgcgtgaaagctccaccgtcatatcctgtttggctatggtatcttcccgattggtatagaaactgagtccggtcccctgctcgtcatgcaaatccagatttgcatgaatccgcccgttgtcagccagataaatatagttatttttattcacggtaaaaggacggtataccaacgtgggatgctccggaaaaaccttcatgcgtatgccgtggcggcgcaggtcggccatcactcccatatatactccctgttctttacgggcattcaggtattgaaccaacaactgggcgctgttgtttcccacatttccctccagcgtcacatcaaacgcctcctgtcccggtttgggtccgttcaccactccgctcaacatatttatgccattcaggtcctgctgtacatccagataaatggtatccaaagtcaggctgtctgtacgcaatccatataaataagcctccccgttcaatccctctgccggagatgaatccacatccataaacagacgactgtatgacaaccccatcattgacagataattggctatcggattatcgggaccggaagatattttcagacatagtcccggaagaaattcccgaagctcctcctgttcaatatgtttgctttcccattgttccgctagtttcttcatcagcaaatccgccctgctggaaatgtattccatgtgccctgctccttccagactcaaatcaagatcccccgcacgcagataagcaaaagtggaatctctggaagtgctgaatccggcaaacaggtccttggaatgggaagtgcgtttggcagtgacaatcgtagcattcgtcatctcggcctctacgacatacctttttctgaggtcactgctgaaacggacacccaggtgctgggaggtctgaaaacgggtatccatcagatgaagcgcctgccaatccaaatgagccacatccattttcaagtcgcccgaaacatcatgaggtttcaagataccatccagatgcgccttgatatccatggtccagtttttcactgccagtgaagcgtgcaccttcgatttctccagtccggcagccagtgagattcctgtcaaatgataactgccataatggaaacggtctataccgccctccgcattgaaataagtacggggagagaaaaagtcaaaaccttccccctccactttcagacgggtggacaaggtgtacaaagaatcggcaggcataaactggtgcaggtcaaaatgattgacagccaagtctgcctcatacctgtcacgcgacaagtcgtatttggcaaacagacgggccgcccgttccatcttgaaatcatcagccacggaaatgctgtcattataaactgttataggaatggtatcggccgcagccaccgcttgggcttcgggctgcatcagcagcaggtccgtgcccattttagcgcccgccatcgtaaatttgccttccaagcgcgttccgtatggaatttctattccttcagccaacgtggaaacaaacttcaaatccttggtttcagcttccaaggtgatatcccctccgcgcagcagactgtctgtcagatgggtcagctccccccgggcgaacaatcccaatgcgccgggcagctcggcagtcagcgtagtcagtttcagcttgttcaaatcgccgtcgatccctgtacggatgcgcagaggttcggaagggtactgccggacaaacttttcatccatacgtcccatgaatctcaccacatccggctttcctatatcggccatcagccgtgcggacaccaagccttcacctttgaaatccaaggcattccaatccatcgcagcgttcagttccaaataagaatcccgggtttccagtttcaatgaaggcacacgcagcaccttgtcattggaaaccatccgccctgtggcagaaacgatttccactcccgaacgctctttcagcacaaactggctgattatggctttcatattcctgccttcgtagtacagggagtccagtttcacaccgatatccgtcagtgcaatatgggacgggtccagtccggagggcaggctgtcggcagccagcggcttcccgctgtcgtagcgcacacgtccgttctttatccggaacgtttgcagcgaataggccgatttatgcaagtctatcagcccgtcgcgcagtatggcattatccagcgaagccgccaatgacaggctgtccaaaggcatatccagcgcaaaggacacattctgcaaatcaatatcctgcaatattattttccaataagtggtgtcgcttgcagccgtatcgaccgcagcagtgtcattcaggcagagagataaatccgtatctttcaacaagactttgttaacgatggcagtttcggggtccagcgccactccatgactggaaatgaacaattcccccaaagtaccgttcaacttcatgccatgtatcaagtcattagaattcactgtggctccctgcagggatatgccatccacttccacctgcttcttcagcaatggcagcaactgcacattcacttgcaggcggcgtacactgagcaacgtatcattatgcggggaagcggcatctacatcggtcaccaccagattcaacggaaaagacaaagagatacgtcccacggagatattcataccggtagcttccgaggcatatacagcagctttgtccaccagaaagttctgaatgggtggcaaataaatcaatatacataaaatgacgaacagaatgaacggagatgctatcgtccacaatgtccaacgaacatattttttcttcatcgagtgtctgtacaagtattcctgcaaatttaaacaattttatcggcataatggttgaaagaacgcagcttttatcttttgtttcccataatttattaaaaaagaacttacggactacctgttgccactaggaaagatctataatcttacccccgcaaaatttaaatctttcagctctcccgtctgttcccataacatgaacaatacggacaagccgacagatttccaagaagacggaagctacttccaacgtagacgcagttcctttttctcacacacgtgcgcgcatattacaatatgatataaatccggcatccttcatcaaagacttccctctgaaacgatggatgccatactagtattcaatgcgaatttcaagacttatgcaaaccatgttattcagaaacttttttaattttctttttccagtattatcatccccttccggttttgccgccggtctttttatcttttttccttcgtcttttctctttccggtgcttctcttctcctcactctgccccatttatttttcttctctacaaattattaagaacacgcacgtttgtgagaaaaaaagacctggttctgtcgcgtctgcatctgaagtattcctccgctctctccctttttttatccttcctttcttcgcttttccgctcttactctcaattttatttcctatctttgtccgataaataaaaaatagctcatgacttcaaacaaaattttactaatatgcctggccttcattgcattgactgcatgcaacgccggctcgaaaagacaaacaaatcatcatatggaaaatgaaaagcgtaccttggtaaaactggaaaccaccatgggaaatatcacagtggccctgtataatgaaacgccgaaacatcgtgataactttatcaaactggtaaaagaaggagtatatgacagtacattgttccaccgggttatcaaacaattcatgatccaagctggcgatccggacagcaaaaacgcatcggatactgccatgctgggcagcggtgatgtgggttacaccattcccgctgagttcaatccgaaattcttccacaagaaaggagtattggcggcagcacgccagggtgatgatgtgaaccccgaaaaggcttcatcgggttgccagttctatattgttaccggacgcaagttcaccgaaccgcaattgctgggcatggagaacaaaataaacgaacagcgtgaagaggctctgttcgacagtctggcacgccagcacatgaaggaaatatacaagatgcgcaaggcaggagacaatgccgggttactggaattacaggacaccttggaagcccaagcccgtgagctggcggacaaagaagagaaattccgcttcacccccgaacagatcaaagcatacagcaccataggcggcgctccccacctggacggttcttataccgtattcggtgaagtaaccgaaggtatggaagtagtggacaatattgaaatagcaaaaacgaaccgcgcagaccgccctatagagaatatccggattctcaaggcaagtattcagtaatttgcgactcagatgattaacattaaccgatacaccttgtccaacgggctgcgtgtgatacacaatgaggacaatacgactcagatggtggcattgaacctactgtacgatgtgggcgcacgcgatgaagatcctgatcataccggattcgcccatctgtttgagcacctgatgttcggaggctccgtccatgtgcccgactatgacactccggtacaaaatgccggaggcgaaaacaacgcatggacaaataatgacataaccaattattacatcaccctccctcgtcagaatgtggaaaccggattctggttggagagtgaccgtatgttatccctcgactttaacccgcgcagtctggaagtgcaacggcaagtggtaatcgaagagttcaaacagcggaacctgaaccagccatacggagacgcctcacatctgctacgcgccctagcttataaggtgcatccgtaccagtggcctaccatcggtaaagaaatcagccacatagccaatgccacccttgaagaggtgaaagcctttttctttaaatattatgcaccggacaacgccattctggctgtaacgggacatattacttttgaagagacagtgacattggctgaaaagtggttcggccctatcccgcgccgcaacgtagccccccgctcactgccggcagaaccccggcaaacggaggaacgccgactgacagtagagcggaacgtgcctgtagacgcgctctttatggcattccatatctgtgaacgacgccatcccgactactatgcttttgatatgctaagcgacttgctgagcagcggacgttcctgccgtctggtgcagcatctggtacaagagaaacaggtattcaacagtatcgacgcctatatatcgggcagcattgacgagggattgttccatatcaccggcaaacccgccccaggcgtcacgctggaagctgccgaagctgccgtatggcaggaactgaaggcattgacagaagaaagtgtggatgaagacgagctggaaaaagtaaagaaccgctatgaaagcgaacagatattcaataacctgaattacctgaatgtggctaccaatctggcttattttgaactgaccggcaaagcggaagatattaacaatgaagtaaacaaatatcgctcggtcactgccggccaaataaaagaagctgcacaaaaaacatttgtgcgagaaaattgttccacactctactataaaagtaatttgccgacctgataatatgctaatttgccaactggctgcgccatgcggaacacagcacagccagttggcaaattagcatattggcacattagcaatttattaaccatgcaacattacaaagcacttttcactttaggtatccctatcgttatcggccagataggtgtcatcattttgggttttgccgatacattgatgataggccatcacagcacgaatgaattagccgccgccagttttgtcaacaatatgtttactttggccattattttcgctaccggattctcatacgggctgactcctatcgtagggagtctgttcggacggggagaaacccatgtagtgggacgaatgctgaagaacagcctatttgccaacacactgctggccgtattgctcacactcatcatgtggatactttatctgaatatccaccgactggggcaacccgaagaactgctgcctttaatgcgtccctacttcatcgttttgctgatatccttgttgtttgtactgcttttcaacggtttcaagcaatttgccgacggcataaccgatacccgcgtttccatgtggatcttattgacaggaaatgtaatgaacattatcggcaactacattctgatttacggtaaactgggaatgcccgaaatgggattgctgggagcgggaatttccacattggcctcccgtatcatgatggtggtcgtgttcgccgtcatttttttctgtacccgacgttatcatatttataaagaaggatttctgcacaatacgctcaaccgggcagacttcctgcacctgaacaaaatgggatggcccattgccatgcagatgggaatggaaactgcttcgttcagtctcagtgccattatggtgggatggatcgggactactgctctggcggcccaccaagtgatgctcgccatttcccaaatctgctttatgatgtattatggcatgggagcagccgttgccgtgcgggttagcaacttccgcggacagaatgaccggatgaacgtccggcgctctgcatacgccggattccatatcatgctgctcatcgcactgataggcgccctgcccatcttcctgctgcgtaacgaactgggaggatggttcagcgacagtccggcggtcagcgtaatggtagcacaacttatcattccgttcatcatctaccagtttggtgatggattacagataaatttcgccaatgcccttcgtggaatcgcagatgtgaaacccatgatgtatatcgcattcatcgcctatttccttatctccctgcctgccggctattttttcggtttcatcatggattggggaatcataggaatatggatggcatttcctttcggactgactacagccggaatactctattacctgcgctttaaccgtgatacgaaataaaaataaaaccaccatgagcctgcccaaccgttctaccaagctgaaagttgcattcggctatattctgctgactgcactgctctttatatctatcggatatatctatcaagaaatgaagtcactgtccggaaccggtgatgatgaagccatcctgagccaacggcgccatgtcaccaaccaaattatcggccagctctatcaggcggaagtcatcggacaatcgctcagtacgggacaaatagaacaatactaccgataccaacgagccatgaaacaagccaccacggcacttgactccctacgcacgttgctgacagacagcatacaactggcgcgactggataccgtaggaatgcttttcatggataaagaacggaatatgcgcaacctgctgaaagcaattcaggacggtgggacagatatactttacaaacagcatatagacgaactgatcgcccagcaagattccttgctcagccttccccatgtacgaaaaaaagtaatcacacacaccaattcttatattattcgtaaaaagcccaaaagcttcttcaaacgtttgggagaagtgttctcgcccggaaaagcagattccacacaggtcaacaatgtgattcaggaagaatataccgatacgctgaccgaggcatacagtccggcagatactgtggtcaccatgttgaaaaacatacagagccgagtaaccgatacccaacaagaacgtatggaaatggtcaatcgccgcacccagtccctgcgcctcagcggcttgaaactaagtcagaaagtcaatcagctattaagtactatagaggaagaagagcaagctttggcccaaaacaaacatatacaagaggaatatattcgccaaagctctatccgcacagtggcgggaatcgccattgtcgctgtggttctggctattttctttctggtcctgatatggagagacatcactcgcagcaaccactaccgccgagaactggaaaaagccaaacgccgcgccgaagacttactggcggcgcgtgaaaaactaatgctgaccatcacccacgatatcaaagctcccgtaggttccatcttgggctataccgacctgctggagcggatcactaccgaa
